United States Patent
Humphreys et al.

(10) Patent No.: US 8,815,249 B2
(45) Date of Patent: Aug. 26, 2014

(54) Ii-KEY/ANTIGENIC EPITOPE HYBRID PEPTIDE VACCINES

(75) Inventors: Robert Humphreys, Acton, MA (US); Minzhen Xu, Northborough, MA (US)

(73) Assignee: Antigen Express, Inc., Worcester, MA (US)

(*) Notice: Subject to any disclaimer, the term of this patent is extended or adjusted under 35 U.S.C. 154(b) by 0 days.

(21) Appl. No.: 12/843,466

(22) Filed: Jul. 26, 2010

(65) Prior Publication Data

US 2010/0291145 A1   Nov. 18, 2010

Related U.S. Application Data

(60) Continuation of application No. 11/033,039, filed on Jan. 11, 2005, which is a continuation-in-part of application No. 10/245,871, filed on Sep. 17, 2002, now abandoned, which is a continuation-in-part of application No. 10/197,000, filed on Jul. 17, 2002, now Pat. No. 7,205,274, which is a division of application No. 09/396,813, filed on Sep. 4, 1999, now Pat. No. 6,432,409.

(51) Int. Cl.
  A61K 39/00   (2006.01)
  A61K 39/385  (2006.01)
  A61K 39/145  (2006.01)
  A61K 48/00   (2006.01)
  A61K 38/04   (2006.01)

(52) U.S. Cl.
USPC .............. 424/185.1; 424/192.1; 424/193.1; 424/196.11; 424/209.1; 514/44 R

(58) Field of Classification Search
None
See application file for complete search history.

(56) References Cited

U.S. PATENT DOCUMENTS

| | | | |
|---|---|---|---|
| 6,432,409 B1* | 8/2002 | Humphreys et al. | 424/192.1 |
| 7,205,274 B2* | 4/2007 | Humphreys et al. | 514/20.6 |
| 2003/0235594 A1* | 12/2003 | Humphreys et al. | 424/192.1 |
| 2006/0002947 A1* | 1/2006 | Humphreys et al. | 424/185.1 |
| 2008/0095798 A1* | 4/2008 | Humphreys et al. | 424/204.1 |

FOREIGN PATENT DOCUMENTS

WO   WO0156355 A2 *   8/2001
WO   WO 2007095318 A2 *  8/2007

OTHER PUBLICATIONS

Fahey et al. (Clinical Exp. Immunol. 1992,88: 1-5).*
Letvin, N (Science, 1998, 280: 1875-1880).*
Machuca et al. (Intervirology, 1999, 42: 32-42).*
Merck Manual (16th Ed.I, Berkow, Rahway, NJ , Merck Res. Lab., p. 21).*
Encyclopedia Brittanica Online (2004, search.eb.com, 2 pages).*
Desrosiers, R.(Nature, 2004, 10(3): 221-223).*
Uchijima et al (J. Immunol. 1998, 161: 5594-5599).*
Paul (Fundamental Immunology, 5th Ed., Lippincott Williams & Wilkins, Philadelphia, 2003, pp. 1334-1335).*
Geneseq Accession No. AJF49154, 2007, 1 page.*
Malhotra et al (J.Clin. Invest. 2001, 107(4): 505-517).*
Disis et al (J. Clin. Oncol. 20: 2624-2632, Jun. 2002).*
Geneseq Accession No. AAU12557 Sep. 2003.*
Suarez et al (J. Virol. 1998, 72: 6678-6688).*
Kwok et al (Trends in Immunol., 2001, 22(11): 583-588).*

* cited by examiner

Primary Examiner — Michael Szperka
Assistant Examiner — Marianne DiBrino
(74) Attorney, Agent, or Firm — Pierce Atwood LLP; Kevin M. Farrell; David J. Wilson

(57) ABSTRACT

Disclosed is a nucleic acid molecule comprising a first expressible sequence encoding a protein of interest or polypeptide of interest which contains an MHC Class II-presented epitope, or said encoded protein or peptide. In addition, the nucleic acid molecule comprises a second expressible nucleic acid sequence encoding an antigen presentation enhancing hybrid polypeptide, or said encoded protein or peptide. The antigen presentation enhancing hybrid polypeptide includes the following elements: i) an N-terminal element consisting essentially of 4-16 residues of the mammalian Ii-Key peptide LRMKLPKPPKPVSKMR (SEQ ID NO: 1) and non-N-terminal deletion modifications thereof that retain antigen presentation enhancing activity; ii) a C-terminal element comprising an MHC Class II-presented epitope in the form of a polypeptide or peptidomimetic structure which binds to the antigenic peptide binding site of an MHC class II molecule, the MHC Class II-presented epitope being contained in the protein of interest of step a); and iii) an intervening peptidyl structure linking the N-terminal and C-terminal elements of the hybrid, the peptidyl structure having a length of about 20 amino acids or less.

8 Claims, No Drawings

Ii-KEY/ANTIGENIC EPITOPE HYBRID PEPTIDE VACCINES

RELATED APPLICATIONS

This application is a Continuation of U.S. application Ser. No. 11/033,039 (filed Jan. 11, 2005), which is a Continuation-in-part of U.S. application Ser. No. 10/245,871 (filed Sep. 17, 2002), abandoned, which is a Continuation-in-part of U.S. application Ser. No. 10/197,000 (filed Jul. 17, 2002), now U.S. Pat. No. 7,205,274, which is a Division of U.S. application Ser. No. 09/396,813 (filed Sep. 4, 1999), now U.S. Pat. No. 6,432,409. U.S. application Ser. No. 10/245,871 is incorporated herein by reference.

BACKGROUND OF THE INVENTION

The immune system responds to foreign pathogens, to tumor cells, to autoimmune disease-inducing processes, to allergens, to grafts, through the recognition of the 'foreign' or 'abnormal' structures, as antigens. Most of those antigens are proteins, which are synthesized either by cells of the host, or by a pathogen. Such antigens are processed (proteolytically digested) into peptide fragments which come to be presented to the responding lymphocytes of the immune system, in a peptide-presenting structure on the surface of the antigen presenting cell. Those peptide presenting structures are called major histocompatibility complex (MHC) molecules. They obtained that name since they were first recognized as products of polymorphic, allelic genes in the MHC locus, which genes control graft rejection among inbred strains of mice.

The immune response to a specific antigen is mediated by T lymphocytes which recognize peptide fragments of those antigens in the MHC molecules. Within an antigen presenting cell (APC), peptide fragments of a proteolytically processed antigen become bound into the antigenic peptide binding site of major histocompatibility complex (MHC) molecules. These peptide-MHC complexes are then transported to the cell surface for recognition (of both the foreign peptide and the adjacent surface of the presenting MHC molecule) by T cell receptors on responding T lymphocytes. Those T lymphocytes can have either immunoregulatory functions (to help or suppress an immune response) or effector functions (to clear the pathogen or tumor, for example, through a cytotoxic immune response). The antigen-specific recognition event initiates the immune response cascade which leads to a protective immune response, or in the case of autoimmune processes, a deleterious immune response.

Two classes of MHC molecules function as immune system presenters of antigenic peptides to T cells. MHC class I molecules receive peptides from endogenously synthesized proteins, such as an infectious virus, in the endoplasmic reticulum about the time of synthesis of the MHC class I molecules. The MHC class I-bound antigenic peptides are presented at the cell surface to CD8-positive cytotoxic T lymphocytes, which then become activated and can directly kill the virus-expressing cells. In contrast, MHC class II molecules are synthesized in the endoplasmic reticulum with their antigenic peptide binding sites blocked by the invariant chain protein (Ii). These complexes of MHC class II molecules and Ii protein are transported from the endoplasmic reticulum to a post-Golgi compartment where Ii is released by proteolysis and a specific antigenic peptide becomes bound to the MHC class II molecule (Blum et al., *Proc. Natl. Acad. Sci. USA* 85: 3975 (1988); Riberdy et al., *Nature* 360: 474 (1992); Daibata et al., *Mol. Immunol.* 31: 255 (1994); Xu et al., *Mol. Immunol.* 31: 723 (1994); Xu et al., Antigen Processing and Presentation, Academic Press, NY p227 (1994); Kropshofer et al., *Science* 270: 1357 (1995); and Urban et al., *J. Exp. Med.* 180: 751 (1994)).

R. Humphreys (1996) U.S. Pat. No. 5,559,028, and Humphreys et al. (1999) U.S. Pat. No. 5,919,639 revealed the mechanisms by which Ii protein is cleaved, releasing fragments in the course of cleavage to regulate the binding and locking in of antigenic peptides within the antigenic peptide binding site of MHC class II molecules (Adams et al., *Eur. J. Immunol.* 25: 1693 (1995); Adams et al., *Arzneim. Forsch./Drug Research* 47: 1069 (1997); and Xu et al., *Arzneim. Forsch./Drug Research in press* (1999)). One segment of the Ii protein, Ii(77-92), was found to act at an allosteric site outside the antigenic peptide binding site near the end of that site holding the N-terminus of the antigenic peptide. The referenced patents, furthermore, disclosed novel therapeutic compounds and methods to control this initial regulatory, antigenic peptide recognizing event of the immune response by three classes of mechanisms. In the first mechanism, antigenic peptides are spilled from cell surface MHC class II molecules by the action of compounds of the invention.

In the second, the charging of the antigenic peptide binding site on those molecules is promoted with compounds of the invention for binding of other, synthetic peptides. Such inserted peptide sequences can be either antigenic epitopes or nonantigenic peptide sequences which nevertheless bind tightly to block the antigenic peptide binding site. The third mechanism involves altering the rates of association/dissociation of antigenic peptides from those complexes and the nature of the interaction of components of the trimolecular MHC molecule/antigenic peptide/T cell receptor complex, and furthermore the interaction of that trimolecular complex with auxiliary cell-to-cell interaction molecules, in a manner to regulate differentiation and function of the responding T lymphocytes.

The identification of the mechanisms referred to above opens new avenues of therapeutic intervention. New methods and compositions based on these discoveries offer the promise of epitope-specific therapies.

SUMMARY OF THE INVENTION

The present invention relates, in one aspect, to an antigen presentation enhancing hybrid polypeptide which includes three elements. The first element is an N-terminal element consisting essentially of 4-16 residues of the mammalian Ii-Key peptide LRMKLPKPPKPVSKMR (SEQ ID NO: 1) and non-N-terminal deletion modifications thereof that retain antigen presentation enhancing activity. The second element is a chemical structure covalently linking the N-terminal element described above to the MHC Class II-presented epitope described below. The chemical structure is a covalently joined group of atoms which when arranged in a linear fashion forms a flexible chain which extends up to the length of 20 amino acids likewise arranged in a linear fashion, the chemical structure being selected from the group consisting of: i) immunologically neutral chemical structures, ii) a MHC Class I epitope or a portion thereof, and/or iii) an antibody-recognized determinant or a portion thereof. Finally, the enhancing antigen presentation enhancing hybrid polypeptide includes a C-terminal element comprising an antigenic epitope in the form of a polypeptide or peptidomimetic structure which binds to the antigenic peptide binding site of an MHC class II molecule.

DETAILED DESCRIPTION OF THE INVENTION

As discussed in the Background of the Invention section of the present disclosure, U.S. application Ser. No. 09/396,813

(now U.S. Pat. No. 6,432,409) discloses hybrid peptides useful in connection with modulation of the immune system (referred to herein as "the '813 enhancing hybrid peptide"). The disclosure was based on the discovery that an MHC Class II-restricted antigenic epitope which is covalently linked to a mammalian Ii key peptide by an appropriate intervening chemical structure, to form a hybrid polypeptide, is presented to T lymphocytes by antigen presenting cells with significantly higher efficacy than is the precursor antigenic epitope. The disclosure of U.S. Pat. No. 6,432,409 is incorporated herein by reference.

The hybrid polypeptide disclosed was referred to as an "MHC Class II antigen presentation enhancing hybrid polypeptide", or more simply as an "enhancing hybrid". In this disclosure, such peptides have also been referred to as "Ii-Key/antigenic epitope hybrids" or "hybrid peptides". Alternatively, short-hand designations based on functional elements may be used, particularly in the Exemplification section. For example, Ii-Key/MHC Class II-presented antigenic epitope hybrids, Ii-Key/MHC Class II-presented antigenic epitope/MHC Class I-presented antigenic epitope hybrids, Ii-Key/MHC Class II-presented antigenic epitope/antibody-recognized determinant (ARD) hybrids. The preceding listing of alternative terminology may not be comprehensive, but reference to such enhancing hybrids will be clear in context.

The '813 enhancing hybrid has an N-terminus comprised of a mammalian Ii-Key peptide, or a modification thereof, which retains antigen presentation enhancing activity. Covalently, but indirectly, linked to the Ii-Key peptide is the specific MHC Class II antigenic epitope to be presented. Between the Ii-Key peptide and the antigenic epitope is an intervening chemical structure which covalently links the other two components. This intervening chemical structure was referred to simply as a "spacer". Necessary parameters of the spacer were described in detail.

The present disclosure specifically contemplates enhancing hybrid peptides containing antigenic epitopes/determinants in addition to the MHC Class II antigenic epitope disclosed in connection with the '813 enhancing hybrid. For example, the enhancing hybrids of the present invention may contain multiple MHC Class II epitopes. The inclusion of multiple MHC Class II epitopes enables a greater fraction of the human population to be immunized because the multiple epitopes are frequently presented by different alleles. In addition to a plurality of MHC Class II epitopes, the present invention also contemplates the inclusion of one or more MHC Class I epitopes and/or one or more ARDs (Antibody Recognized Determinants). The expressions "epitopes" and "determinants" are considered as synonyms by many skilled in the art. The use of the expression "epitope/determinant", as used herein, is intended to encompass MHC Class II epitopes, MHC Class I epitopes and ARDs.

The Exemplification section which follows provides numerous specific examples of experimentally-determined or predicted MHC Class II epitopes, MHC Class I epitopes and ARDs, which can be incorporated in enhancing hybrid peptides. The experimentally determined epitopes are preferred over algorithm-predicted epitopes for preclinical trials in animal models for human disease, in part, because a significant percentage of algorithm-predicted epitopes are not found to be biologically functional. Nevertheless, the "significant percentage" is sufficiently small that such epitopes are a source of sequences for the development of enhancing hybrids. In the context of a focus on a particular disease or condition, reference is made to the compounds and methods of use described in the corresponding Exemplification section which follows.

As will be discussed below, the use of the '813 enhancing hybrid peptide to enhance or augment an MHC Class II-mediated immune response, created an untapped immune reservoir. As will be discussed in greater detail below, the interaction of the '813 enhancing peptide with cells of the immune system greatly amplified a number of responsive cell types. Molecular input for a subset of these responsive cell types, in the form of the MHC Class II epitope component of the enhancing hybrid, were provided. However, large numbers of primed and responsive immune cell types were stimulated by the '813 peptide, but no provision for appropriate molecular inputs was provided. Such additional molecule inputs, in the form of MHC Class I epitopes and ARDs, is provided herein.

More specifically, the enhancement of the T helper cell stimulation mediated by the Class II epitope of the '813 peptide is substantially augmented (i.e., about 250 times) by the effect of the Ii-Key moiety. The clonal expansion of an immunoregulatory cell type, such as an activated T cell, has a cascading effect through the immune system. As discussed above, this can create an excess of immune capacity which has not been addressed in the prior art.

Ultimately, an MHC Class II-presented antigen which is an element of the hybrid peptide (either an enhancing hybrid peptide of the present invention or an '813 enhancing hybrid peptide), exerts its influence through presentation by an MHC Class II molecule on the surface of an antigen presenting cell. Two particularly important classes of antigen presenting cells are dendritic cells and macrophages. These antigen presenting cells have on their respective surfaces two types of special molecules that function in antigen presentation. These two types of molecules are MHC Class I and MHC Class II molecules. Antigenic peptides (e.g., MHC Class I or MHC Class II epitopes) are noncovalently bound to MHC Class I or MHC Class II molecules for subsequent presentation to antigen-specific receptors on T cells.

While not wishing to be bound by theory, it is thought that peptides containing MHC Class I and/or MHC Class II epitopes may be displayed on the surface of an antigen presenting cell in association with the cognate display molecule (i.e., MHC Class I molecules or MHC Class II molecules) through at least two mechanisms. For example, following contact with an antigen presenting cell, such peptides may be internalized by the antigen presenting cell and processed through classical channels. Alternatively, the MHC Class I or MHC Class II-presented antigen portion of such a peptide may bind directly to an MHC Class I or MHC Class II molecule on the surface of an antigen presenting cell. Thus, in both cases, the MHC Class I or MHC Class II-presented epitope of the peptide is displayed on the surface of an antigen presenting cell in association with its cognate MHC Class I or MHC Class II molecule.

Such an MHC Class II-associated display triggers a cascade of immune-mediated effects including the induction of T cells and the subsequent expansion of this induced population. T helper cells, stimulated in this manner, respond in a variety of ways. For example, stimulated T helper cells function by releasing cytokines that provide various activation signals for B cells. B cells produce a surface immunoglobulin which can recognize and specifically bind to an ARD element which is present, for example, on a protein or peptide which contacts the cell surface. The protein or peptide is then internalized and any processed MHC Class I or MHC Class II-presented epitopes present are subsequently displayed on the B cell surface in association with MHC Class I or MHC Class II molecules, respectively.

The example of an ARD-containing molecule provided in the preceding paragraph was a protein or peptide. In connection with the present invention, the ARD is provided as an element of an enhancing hybrid peptide. As was the case in the previous example, the enhancing hybrid peptide is internalized by the B cell and any MHC Class II epitopes present as an element of the enhancing hybrid are processed for display on the surface of the B cell in association with MHC Class II molecules. Such presentation further stimulates the helper T cell population resulting in proliferation and maturation of B lymphocytes to plasma cells which produce the antibody specific to the ARD.

The enhancing hybrid polypeptide of the present invention is comprised of 3 elements, as was the '813 enhancing hybrid. The 3 elements are: 1) an N-terminal element consisting essentially of 4-16 residues of the mammalian Ii-Key peptide LRMKLPKPPKPVSKMR (SEQ ID NO: 1) and non-N-terminal deletion modifications thereof that retain antigen presentation enhancing activity; 2) a C-terminal element comprising an MHC Class II-presented epitope in the form of a polypeptide or peptidomimetic structure which binds to the antigenic peptide binding site of an MHC Class II molecule; and 3) an intervening chemical structure covalently linking the N-terminal and C-terminal elements of the hybrid, the chemical structure being a covalently joined group of atoms which when arranged in a linear fashion forms a flexible chain which extends up to the length of 20 amino acids likewise arranged in a linear fashion.

The included additional epitope(s) or determinant(s) which distinguish the enhancing hybrid of the present invention from the '813 enhancing hybrid are preferably located within the C-terminal element or the linker element. Additionally, an epitope or determinant may overlap the C-terminal element and the linker element. In some circumstances it may be possible for an additional epitope or determinant to overlap between the linker element and the N-terminal Ii-Key moiety.

Generally speaking, MHC Class I and MHC Class II epitopes are comprised of from about 8 to about 12 amino acid residues. ARD elements are typically have a size range somewhat broader than MHC Class I and MHC Class II epitopes. A commonly cited size range for ARDs is from about 6 to about 16 amino acid residues. ARDs are recognized based on their 3-dimensional structure whereas MHC Class I and MHC Class II epitopes are recognized on the basis of their linear, primary amino acid structure.

To provide specificity to the options outlined in the preceding paragraph, it is necessary to discuss the anatomy of the enhancing peptide of the present invention in greater detail. The linker sequence has been described as an intervening chemical structure covalently linking the N-terminal and C-terminal elements of the hybrid, the chemical structure being a covalently joined group of atoms which when arranged in a linear fashion forms a flexible chain which extends up to the length of 20 amino acids likewise arranged in a linear fashion. Thus, to the extent that the linker sequence is comprised of amino acids (which is not a requirement), the disclosure of the present invention provides an additional functionality to the amino acid residues of the linker, above and beyond their required role as space occupiers.

The specified linker length (up to 20 amino acids arranged in a linear fashion) is long enough to contain a second complete MHC Class II epitope, a first complete MHC Class I epitope, or a first complete ARD or segments of such additional epitopes. Additionally, such a sequence length can accommodate a plurality of non-overlapping epitopes selected from the group consisting of MHC Class I epitopes, MHC Class II epitopes and ARDs.

It is known in the art that functional MHC Class I epitopes, MHC Class II epitopes and ARDs may be arranged in an overlapping manner while retaining full functionality of all represented epitopes. The respective functions of each epitope within a hybrid are not co-expressed at one point in time on a per peptide basis, because such peptides must be bound into MHC Class I or MHC Class II molecules and recognized in a folded structure by an antibody. Nevertheless, given a population of injected peptides with respective processing and/or binding to cell surface MHC molecules, all three classes of epitopes within any one Ii-Key enhancing hybrid can be effective immunogens within an immunized animal.

Minimum sequences are preferred for several reasons. These include simplicity and cost of synthesis, less opportunity for proteolytic degradation, less opportunity for metabolic change leading to clearance or adsorption. Thus, the linker element may contain a plurality of epitopes which overlap one another (i.e., an individual amino acid residues may be a components of more than one epitope). Similarly, the C-terminal element which includes an MHC Class II-presented epitope may also contain additional epitopes (MHC Class I, MHC Class II or ARD) in an overlapping or non-overlapping arrangement.

It is noted that the boundaries between the various elements of the enhancing hybrid peptide of the present invention are, within certain stated limits, somewhat arbitrary. Epitopes spanning the junctions between the various elements are encompassed within the scope of the present invention. Thus, for example, where a claim specifies that a portion of an epitope is contained within one of the enhancing hybrid peptide elements or domains (e.g., the linker region), this necessarily implies that the remaining portion is found in a contiguous portion of a flanking portion or domain. Partial (i.e., non-functional epitopes are of no utility in connection with the present invention).

Early work in this area demonstrated that the mammalian Ii key peptide LRMKLPKPPKPVSKMR (SEQ ID NO: 1), and a modified mammalian Ii-key peptide, YRMKLPKPPKPVSKMR (SEQ ID NO: 2), have the ability to alter presentation of certain MHC Class II-restricted, antigenic peptides to T lymphocyte-hybridomas which recognize those respective antigenic peptides (U.S. Pat. No. 5,559,028; U.S. Pat. No. 5,919,639, the disclosures of which are incorporated herein by reference). Previous experimentation with modified versions of the Ii-key peptide have indicated that a wide variety of modifications can be made to this polypeptide without detriment to activity. Indeed, modifications often enhanced antigen presentation activity of the polypeptide.

Results detailed in the Exemplification section of U.S. application Ser. No. 09/396,813, now U.S. Pat. No. 6,432,409, indicate that all modified Ii key peptides which retain antigen presentation enhancing activity will function in the enhancing hybrid of the present invention when appropriately incorporated. Modifications of the Ii key peptide include deletion of one or more amino acids from the C-terminus, protection of the N-terminus, amino acid substitutions, and introduction of cyclical peptides. Deletions of the Ii key peptide which retain at least 4 contiguous amino acids of the original sequence, or a substituted version thereof, exhibit functional activity. Various natural or non-natural amino acids may be substituted at respective residue positions. Some examples of molecules which may be substituted are peptidomimetic structures, D-isomer amino acids, N-methyl amino acids, L-isomer amino acids, modified L-isomer amino acids, and cyclized derivatives. In addition, procedures of medicinal chemistry may be applied by one skilled in the art using routine experimental methods to obtain additional modifications of the N-terminal segment of hybrids. Examples of such procedures are methods of rational drug design, molecular modeling based on structural information from X-ray diffraction data, nuclear magnetic resonance data, and other computational methods, and screening of products of combinatorial chemical syntheses, and isolations of natural products. Examples of modified versions of Ii key peptide which are known to retain high activity are LRMK (SEQ ID NO: 3), LRMKLPK (SEQ ID NO: 4), LRMKLPKS (SEQ ID NO: 5), LRMKLPKSAKP (SEQ ID NO: 6), and LRMKLPKSAKPVSK (SEQ ID NO: 7). Other modifications and modified versions of the Ii-key peptide are described in U.S. Pat. No. 5,919,639, and U.S. Pat. No. 5,559,028. A modified version of the Ii-key peptide (YRMKLPKPPKPVSKMR, SEQ ID NO: 2) which is known to retain activity is referred to herein as an 'Ii-key homolog'. The term Ii key homolog as used herein is inclusive of the Ii key peptide itself.

Such Ii-Key peptides were demonstrated by several experimental methods to bind to an allosteric site at the end of the antigenic peptide binding site of MHC Class II molecules holding the N-terminal end of an antigenic peptide. That process of binding to the allosteric site, facilitated the release and exchange of endogenously bound antigenic peptide with cell surface MHC Class II molecules.

Peptide homologs of the Ii-Key peptide act on murine or human MHC Class II molecules to promote the release of bound antigenic peptides and their replacement with synthetic peptides (Adams S. Arneimittelforschung. 1997 47:1069-1077; Xu M. Arneimittelforschung. 1999 49:791-9). Hybrid constructs of the Ii-Key peptide linked to an antigenic epitope peptide through either a simple polymethylene linker or the extended, natural sequence of the Ii protein, have 500 to 2000 times the potency of presentation versus the antigenic peptides (Humphreys R E. Vaccine. 2000 18:2693-2697). This property has great clinical utility in diagnosis, treatment monitoring and therapy of various diseases and conditions, as presented herein. This activity of the Ii-Key moiety within Ii-Key/antigenic epitope hybrids is found either in vitro or in vivo. This activity can be ascribed to interaction with cell surface MHC Class II molecules because the Ii-Key compounds were active in vitro with either living or paraformaldehyde-fixed antigen presenting cells (Adams S. Eur J Immunol. 1995 25:1693-1702). However, since the compounds are potent in vivo, they may also be taken up by the pathway which processes exogenous antigens and bind to MHC Class II molecule sin the post-Golgi, antigen charging compartment.

The MHC Class I epitopes, MHC Class II epitopes and ARDs of the enhancing hybrid of the present invention have been discussed above. Such epitopes/determinants selected for use in the generation of an enhancing hybrid of the present invention may be further modified for use. That is to say, polypeptides of natural or modified sequence, peptidomimetic structures, and also chemical structures which are not natural or modified amino acids may be included in the epitope/determinant elements of the enhancing hybrids disclosed herein. In addition, various chemical modifications may be made to the antigenic epitope/determinant element of the enhancing hybrid. For example, the addition, in whole or in part, of non-natural amino acids, or of other backbone or side chain moieties, wherein the modifications preserve binding specificities of the antigenic epitope/determinant. Such chemical structures might bear moderate, little, or no apparent structural resemblance to any antigenic peptide which is derived from a natural protein sequence. Such modifications might or might not bear on recognition by T cell receptors. Modifications may increase recognition of the antigenic epitope (e.g. lead to recognition by previously non-recognizing subsets of T cell receptors).

The intervening chemical structure, or spacer, has been discussed above. Where the intervening chemical structure comprises one or more epitopes/determinants, the overall length within defined limits is dictated to a large extent by the identity and of the epitope/determinant. In the case in which the intervening chemical structure is antigenically neutral, the teachings of U.S. application Ser. No. 09/396,813, now U.S. Pat. No. 6,432,409, apply. As indicated, the spacer is preferably less than the length of a peptidyl backbone of 9 amino acids linearly arranged. Optimally, spacer length is the length of a peptidyl backbone of between 4 and 6 amino acids, linearly arranged. Preferably, the spacer is unable to hydrogen bond in any spatially distinct manner to other distinct elements of the enhancing hybrid peptide.

Again, with respect to antigenically neutral spacer elements, various chemical groups may be incorporated in the spacer segment instead of amino acids. Examples are described in U.S. Pat. No. 5,910,300, the contents of which are incorporated herein by reference. In a preferred embodiment the spacer is comprised of an aliphatic chain optimally interrupted by heteroatoms, for example a $C_2$-$C_6$ alkylene, or $=N-(CH_2)_{2-6}-N=$. Alternatively, a spacer may be composed of alternating units, for example of hydrophobic, lipophilic, aliphatic and aryl-aliphatic sequences, optionally interrupted by heteroatoms such as O, N, or S. Such components of a spacer are preferably chosen from the following classes of compounds: sterols, alkyl alcohols, polyglycerides with varying alkyl functions, alkyl-phenols, alkyl-amines, amides, hydroxyphobic polyoxyalkylenes, and the like. Other examples are hydrophobic polyanhydrides, polyorthoesters, polyphosphazenes, polyhydroxy acids, polycaprolactones, polylactic, polyglycolic polyhydroxy-butyric acids. A spacer may also contain repeating short aliphatic chains, such as polypropylene, isopropylene, butylene, isobutylene, pentamethlyene, and the like, separated by oxygen atoms.

Additional peptidyl sequences which can be used in a spacer are described in U.S. Pat. No. 5,856,456, the contents of which are incorporated herein by reference. In one embodiment, the spacer has a chemical group incorporated within which is subject to cleavage. Without limitation, such a chemical group may be designed for cleavage catalyzed by a protease, by a chemical group, or by a catalytic monoclonal antibody. In the case of a protease-sensitive chemical group, tryptic targets (two amino acids with cationic side chains), chymotryptic targets (with a hydrophobic side chain), and cathepsin sensitivity (B, D or S) are favored. The term 'tryptic target' is used herein to describe sequences of amino acids which are recognized by trypsin and trypsin-like enzymes. The term 'chymotryptic target' is used herein to describe sequences of amino acids which are recognized by chymotrypsin and chymotrypsin-like enzymes. In addition, chemical targets of catalytic monoclonal antibodies, and other chemically cleaved groups are well known to persons skilled in the art of peptide synthesis, enzymic catalysis, and organic chemistry in general, and can be designed into the hybrid structure and synthesized, using routine experimental methods.

Not all embodiments of the present invention include immunogenic neutrality of the intervening chemical structure, or spacer. That is, the present invention includes embodiments in which the intervening chemical structure, or spacer, is selected from the group consisting of: 1) an MHC Class I epitope, or a portion thereof; and 2) an antibody-recognized determinant, or a portion thereof. In particular, this embodiment is important in connection with the anticipated filing of a counterpart International Application for which the Continuation-in-Part provisions of the U.S. patent law are inapplicable.

The hybrids of the present invention vary from totally peptide in character to substantially non-peptide in character. In view of the fact that some homologs are substantially reduced or non-peptide in character, they will be more likely to have favorable properties, for example, penetration through cellular membranes, solubility, resistance to proteolysis, resistance to inactivation by conjugation, oral bioavailability, and longer half life in vivo.

Also included within the scope of this invention are pharmaceutically acceptable salts of the hybrid molecule, when an acidic or basic group is present in the structure. The term 'pharmaceutically acceptable salt' is intended to include all acceptable salts such as acetate, ammonium salt, benzenesulfonate, benzoate, borate, bromide, calcium edetate, camsylate, carbonate, chloride/dihydrochloride, citrate, clavulanate, edetate, edisylate, estolate, esylate, fumarate, hexylresorcinate, hydrabamine, hydroxynaphthoate, iodide, isothionate, lactate, lactobionate, laurate, mesylate, methylbromide, methylnitrate, methylsulfate, mucate, napsylate, nitrate, N-methylglucamide, oleaste, oxalate, pamoate, palmitate, panoate, pantothenate, phosphate/diphosphate, polygalacturonate, subacetate, sulfate, tartrate, tosylate, triethiodide, valerate, and the like. The pharmaceutically acceptable salt can be used as a dosage form for modifying the solubility or hydrolysis characteristics, or can be used in a sustained release or pro-drug formulation. Depending on the particular functionality for the compound of the present invention, pharmaceutically acceptable salts of the compounds of this invention may be formed from cations such as sodium, potassium, aluminum, calcium, lithium, magnesium, zinc and from bases such as ammonia, arginine, chloroprocaine, choline, diethanolamine, diethylamine, ethylenediamine, lysine, N-methyl-glutamine, ornithine, N,N'-dibenzylethylenediamine, N-benzylphenethylamine, piperazine, procaine, tris(hydroxymethyl)aminomethane, and tetramethylenediamine hydroxide, and the like. These salts may be prepared by standard procedures, for example, by reacting a free acid with suitable organic or inorganic base. When a basic group is present, such as an amino, and acidic salt, i.e., acetate, hydrobromide, hydrochloride, pamoate, and the like, can be used as the dosage form.

Also in the case of an acid (—COOH) or alcohol group being present, pharmaceutically acceptable esters can be employed, for example, acetate, maleate, pivaloyloxymethyl, and the like and those esters known in the art for modifying solubility or hydrolysis characteristics for use as sustained release or prodrug formulations.

The hybrid molecules of this present invention or components thereof may have chiral centers, and therefor may occur as racemates, racemic mixtures, and as individual enantiomers or diastereomers, with all such isomeric forms being included in the present invention as well as mixtures thereof. Furthermore, some of the crystalline forms of hybrid compounds of the present invention may exist as polymorphous and as such are intended to be included in the present invention. In addition, some of the compounds of the present invention may form solvates with water or common organic solvents. Such solvates are also encompassed within the scope of this invention.

The enhancing hybrid of the present invention may be composed of peptide or peptidomimetic or additional chemical groups which may be synthesized and selected by methods which have been developed for the synthesis and selection of antigenic peptides. Those methods and compounds are presented in the following patents: U.S. Pat. No. 4,708,871; U.S. Pat. No. 5,194,392; U.S. Pat. No. 5,270,170; U.S. Pat. No. 5,382,513; U.S. Pat. No. 5,539,084; U.S. Pat. No. 5,556,762; (1997) U.S. Pat. No. 5,595,915; U.S. Pat. No. 5,747,334; and U.S. Pat. No. 5,874,214, the contents of which are incorporated herein by reference.

The disclosure presented above relates primarily to antigen presentation enhancing hybrid peptides. In another aspect, the present invention relates to nucleic acid sequences which encode such enhancing peptides. It is noted that the scope of the enhancing hybrid peptide disclosure is somewhat broader than the corresponding nucleic acid sequence disclosure in light of the fact that enhancing hybrid peptides produced using recombinant DNA techniques from an encoding nucleic acid sequence must be produced from one of the 20 naturally occurring amino acids. A much broader range of substitutions is available when an enhancing hybrid peptide is produced by chemical synthetic techniques.

A wide variety of delivery systems are available for use in delivering the enhancing hybrid of the present invention to a target cell in vitro and in vivo. Such delivery systems include, for example, viral and non-viral systems. Examples of suitable viral systems include, for example, adenoviral vectors, adeno-associated virus, retroviral vectors, vaccinia, herpes simplex virus, HIV, the minute virus of mice, hepatitis B virus and influenza virus. Non-viral delivery systems may also be used, for example using, uncomplexed DNA, DNA-liposome complexes, DNA-protein complexes and DNA-coated gold particles, bacterial vectors such as *salmonella*, and other technologies such as those involving VP22 transport protein, Co-X-gene, and replicon vectors.

One option for expressing a nucleic acid sequence of interest in an animal cell is the adenovirus system. Adenovirus possesses a double-stranded DNA genome, and replicates independently of host cell division. Adenoviral vectors offer a variety of advantages relative to alternative methods for introducing expressible constructs into cells. For example, adenoviral vectors are capable of transducing a broad spectrum of human tissues and high levels of gene expression can be obtained in dividing and nondividing cells. Adenoviral vectors are characterized by a relatively short duration of transgene expression due to immune system clearance and dilutional loss during target cell division. Several routes of administration can be used including intravenous, intrabiliary, intraperitoneal, intravesicular, intracranial and intrathecal injection, and direct injection of a target organ or tissue. Thus, it is recognized in the art that targeting based on anatomical boundaries is achievable.

The adenoviral genome encodes about 15 proteins and infection involves a fiber protein which binds to a cell surface receptor. This receptor interaction results in internalization of the virus. Viral DNA enters the nucleus of the infected cell and transcription is initiated in the absence of cell division. Expression and replication is under control of the E1A and E1B genes (see Horwitz, M. S., In Virology, 2.sup.nd ed., 1990, pp. 1723-1740). Removal of E1 genes renders the virus replication-incompetent.

Adenoviral serotypes 2 and 5 have been extensively used for vector construction. Bett et al. (Proc. Nat. Acad. Sci. U.S.A., 1994, 91: 8802-8806) have used an adenoviral type 5 vector system with deletions of the E1 and E3 adenoviral genes. The 293 human embryonic kidney cell line has been engineered to express E1 proteins and can thus transcomplement the E1-deficient viral genome. The virus can be isolated from 293 cell media and purified by limiting dilution plaque assays (Graham, F. L. and Prevek, L. In Methods in Molecular Biology: Gene Transfer and Expression Protocols, Humana Press 1991, pp. 109-128). Recombinant virus can be grown in 293 cell line cultures and isolated by lysing infected cells and purification by cesium chloride density centrifugation. A problem associated with the 293 cells for manufacture of recombinant adenovirus is that due to additional flanking regions of the E1 genes, they may give rise to replication competent adenovirus (RCA) during the viral particle production. Although this material is only wild-type adenovirus, and is not replication competent recombinant virus, it can have significant effects on the eventual yield of the desired adenoviral material and lead to increased manufacturing costs, quality control issues for the production runs and acceptance of batches for clinical use. Alternative cell lines such as the PER.C6 which have more defined E1 gene integration than 293 cells (i.e. contain no flanking viral sequence) have been developed which do not allow the recombination events which produce RCA and thus have the potential to overcome above viral production issues.

Adeno-associated virus (AAV) (Kotin, R. M., Hum. Gene Ther., 1994, 5: 793-801) are single-stranded DNA, nonautonomous parvoviruses able to integrate into the genome of nondividing cells of a very broad host range. AAV has not been shown to be associated with human disease and does not elicit an immune response. AAV has two distinct life cycle phases. Wild-type virus will infect a host cell, integrate and remain latent. In the presence of adenovirus, the lytic phase of the virus is induced, which depends on the expression of early adenoviral genes, and leads to active virus replication. The AAV genome is composed of two open reading frames (called rep and cap) flanked by inverted terminal repeat (ITR) sequences. The rep region encodes four proteins which mediate AAV replication, viral DNA transcription, and endonuclease functions used in host genome integration. The rep genes are the only AAV sequences required for viral replication. The cap sequence encodes structural proteins that form the viral capsid. The ITRs contain the viral origins of replication, provide encapsidation signals, and participate in viral DNA integration. Recombinant, replication-defective viruses that have been developed for gene therapy lack rep and cap sequences. Replication-defective AAV can be produced by co-transfecting the separated elements necessary for AAV replication into a permissive 293 cell line. U.S. Pat. No. 4,797,368 contains relevant disclosure and such disclosure is incorporated herein by reference.

Retroviral vectors are useful for infecting dividing cells, and are composed of an RNA genome that is packaged in an envelope derived from host cell membrane and viral proteins. Retroviral gene expression involves a reverse transcription step in which its positive-strand RNA genome is employed as a template to direct the synthesis of double-stranded DNA, which is then integrated into the host cell DNA. The integrated provirus is able to use host cell machinery for gene expression.

Murine leukemia virus is a commonly employed retrovirus species (Miller et al., Methods Enzymol., 1993, 217: 581-599). Retroviral vectors are typically constructed by deletion of the gag, pol and env genes. The deletion of these sequences provides capacity for insertion of nucleic acid sequences of interest, and eliminates the replicative functions of the virus. Genes encoding antibiotic resistance often are included as a means of selection. Promoter and enhancer functions also may be included, for example, to provide for tissue-specific expression following in vivo administration. Promoter and enhancer functions contained in long terminal repeats may also be used.

Such viruses, and modifications of such viruses which carry an exogenous nucleic acid sequence of interest, can only be produced in viral packaging cell lines. The packaging cell line may be constructed by stably inserting the deleted viral genes (gag, pol and env) into the cell such that they reside on different chromosomes to prevent recombination. The packaging cell line is used to construct a producer cell line that will generate replication-defective retrovirus containing the nucleic acid sequence of interest by inserting the recombinant proviral DNA. Plasmid DNA containing the long terminal repeat sequences flanking a small portion of the gag gene that contains the encapsidation sequence and the genes of interest is transfected into the packaging cell line using standard techniques for DNA transfer and uptake (electroporation, calcium precipitation, etc.). Variants of this approach have been employed to decrease the likelihood of production of replication-competent virus (Jolly, D., Cancer Gene Therapy, 1994, 1, 51-64). The host cell range of the virus is determined by the envelope gene (env) and substitution of env genes with different cell specificities can be employed. Incorporation of appropriate ligands into the envelope protein may also be used for targeting.

Administration of recombinant retroviral vectors may be accomplished by any suitable technique. Such techniques include, for example, ex vivo transduction of patients' cells, direct injection of virus into tissue, and by the administration of the retroviral producer cells. ex vivo approaches require the isolation and maintenance in tissue culture of the patient's cells. In this context, a high ratio of viral particles to target cells can be achieved and thus improve the transduction efficiency (see, e.g., U.S. Pat. No. 5,399,346, the disclosure of which is incorporated herein by reference). U.S. Pat. No. 4,650,764 contains disclosure relevant to the use of retroviral expression systems and the disclosure of this referenced patent is incorporated herein by reference.

In some cases direct introduction of virus in vivo is necessary or preferred. Retroviruses have been used to treat brain tumors wherein the ability of a retrovirus to infect only dividing cells (tumor cells) may be particularly advantageous. The administration of a retrovirus producer cell line directly into a brain tumor in a patient has also been proposed (see e.g., Oldfield et al., Hum. Gene Ther., 1993, 4: 39-69). Such a producer cell would survive within the brain tumor for a period of days, and would secrete retrovirus capable of transducing the surrounding brain tumor.

Pox virus-based systems for expression have been described (Moss, B. and Flexner, C., Annu. Rev. Immunol., 1987, 5: 305-324; Moss, B., In Virology, 1990, pp. 2079-2111). Vaccinia, for example, are large, enveloped DNA viruses that replicate in the cytoplasm of infected cells. Nondividing and dividing cells from many different tissues are infected, and gene expression from a nonintegrated genome is observed. Recombinant virus can be produced by inserting the transgene into a vaccinia-derived plasmid and transfecting this DNA into vaccinia-infected cells where homologous recombination leads to the virus production. A significant disadvantage is that it elicits a host immune response to the 150 to 200 virally encoded proteins making repeated administration problematic.

The herpes simplex virus is a large, double-stranded DNA virus that replicates in the nucleus of infected cells. This virus is adaptable for use in connection with exogenous nucleic acid sequences (see Kennedy, P. G. E. and Steiner, I., Q. J. Med., 1993, 86: 697-702). Advantages include a broad host cell range, infection of dividing and nondividing cells, and large sequences of foreign DNA can be inserted into the viral genome by homologous recombination. Disadvantages are the difficulty in rendering viral preparations free of replication-competent virus and a potent immune response. Deletion of the viral thymidine kinase gene renders the virus replication-defective in cells with low levels of thymidine kinase. Cells undergoing active cell division (e.g., tumor cells) possess sufficient thymidine kinase activity to allow replication.

A variety of other viruses, including HIV, the minute virus of mice, hepatitis B virus, and influenza virus, have been disclosed as vectors for gene transfer (see Jolly, D., Cancer Gene Therapy, 1994, 1: 51-64). Nonviral DNA delivery strategies are also applicable. These DNA delivery strategies relate to uncomplexed plasmid DNA, DNA-lipid complexes, DNA-liposome complexes, DNA-protein complexes, DNA-coated gold particles and DNA-coated polylactide coglycolide particles. Purified nucleic acid can be injected directly into tissues and results in transient gene expression for example in muscle tissue, particularly effective in regenerating muscle (Wolff et al., Science, 1990, 247: 1465-1468). Davis et al. (Hum. Gene Ther., 1993, 4: 733-740) has published on direct injection of DNA into mature muscle (skeletal muscle is generally preferred).

Plasmid DNA on gold particles can be "fired" into cells (e.g. epidermis or melanoma) using a gene-gun. DNA is coprecipitated onto the gold particle and then fired using an electric spark or pressurized gas as propellant (Fynan et al., Proc. Natl. Acad. Sci. U.S.A., 1993, 90: 11478-11482). Electroporation has also been used to enable transfer of DNA into solid tumors using electroporation probes employing multi-needle arrays and pulsed, rotating electric fields (Nishi et al., in Cancer Res., 1996, 56:1050-1055). High efficiency gene transfer to subcutaneous tumors has been claimed with significant cell transfection enhancement and better distribution characteristics over intra-tumoral injection procedures.

Lipid-mediated transfections are preferred for both in vitro and in vivo transfections (Horton et al., J. Immunology, 162: 6378, 1999). Lipid-DNA complexes are formed by mixing DNA and lipid 1 to 5 minutes before injection, using commercially available lipids such as DMRIE-C reagent.

Liposomes work by surrounding hydrophilic molecules with hydrophobic molecules to facilitate cell entry. Liposomes are unilamellar or multilamellar spheres made from lipids. Lipid composition and manufacturing processes affect liposome structure. Other molecules can be incorporated into the lipid membranes. Liposomes can be anionic or cationic. Nicolau et al. (Proc. Natl. Acad. Sci. U.S.A., 1983, 80: 1068-1072) has published work relating to insulin expression from anionic liposomes injected into rats. Anionic liposomes mainly target the reticuloendothelial cells of the liver, unless otherwise targeted. Molecules can be incorporated into the surface of liposomes to alter their behavior, for example cell-selective delivery (Wu, G. Y. and Wu, C. H., J. Biol. Chem., 1987, 262: 4429-4432).

Felgner et al. (Proc. Nat. Acad. Sci. U.S.A., 1987, 84: 7413-7417) has published work relating to cationic liposomes, demonstrated their binding of nucleic acids by electrostatic interactions and shown cell entry. Intravenous injection of cationic liposomes leads to transgene expression in most organs on injection into the afferent blood supply to the organ. Cationic liposomes can be administered by aerosol to target lung epithelium (Brigham et al., Am. J. Med. Sci., 1989, 298: 278-281). In vivo studies with cationic liposome transgene delivery have been published (see, e.g., Nabel, G., Rev. Hum. Gene Ther., 1994, 5: 79-92; Hyde et al., Nature, 1993, 362: 250-255 and; Conary et al., J. Clin. Invest., 1994, 93: 1834-1840).

Microparticles are being studied as systems for delivery of DNA to phagocytic cells such approaches have been reported by Pangaea Pharmaceuticals. Such a DNA microencapsulation delivery system has been used to effect more efficient transduction of phagocytic cells, such as macrophages, which ingest the microspheres. The microspheres encapsulate plasmid DNA encoding potentially immunogenic peptides which, when expressed, lead to peptide display via MHC molecules on the cell surface which can stimulate immune response against such peptides and protein sequences which contain the same epitopes. This approach is presently aimed towards a potential role in anti-tumor and pathogen vaccine development but may have other possible gene therapy applications.

Natural viral coat proteins which are capable of homogeneous self-assembly into virus-like particles (VLPs) have also been used to package DNA for delivery. The major structural coat protein (VP1) of human polyoma virus can be expressed as a recombinant protein and is able to package plasmid DNA during self-assembly into a VLP. The resulting particles can be subsequently used to transduce various cell lines.

Improvements in DNA vectors have also been made and are likely applicable to many of the non-viral delivery systems. These include the use of supercoiled minicircles (which do not have bacterial origins of replication nor antibiotic resistance genes and thus are potentially safer as they exhibit a high level of biological containment), episomal expression vectors (replicating episomal expression systems where the plasmid amplifies within the nucleus but outside the chromosome and thus avoids genome integration events) and T7 systems (a strictly a cytoplasmic expression vector in which the vector itself expresses phage T7 RNA polymerase and the therapeutic gene is driven from a second T7 promoter, using the polymerase generated by the first promoter). Other, more general improvements to DNA vector technology include use of cis-acting elements to effect high levels of expression, sequences derived from alphoid repeat DNA to supply once-per-cell-cycle replication and nuclear targeting sequences.

In other aspects, the present invention relates to methods for enhancing presentation of an MHC Class II-presented antigenic peptide to a T-lymphocyte. As discussed in U.S. Pat. No. 6,432,409, the MHC Class II-restricted antigenic epitope is appropriately incorporated into the C-terminus of an enhancing hybrid of the present invention, described above. The produced enhancing hybrid is then contacted under physiological conditions to an MHC Class II expressing antigen presenting cell which is in contact with or is then contacted to a T cell which is responsive to the presentation of the antigenic epitope by an MHC Class II molecule of the antigen presenting cell. This method is suitable for use with all antigenic epitopes which conform to the above listed description of an antigenic epitope. Examples of methods to assay such enhancement in vitro are detailed in the Exemplification section below, and in U.S. patents listed in the present disclosure.

In one aspect, the subject invention relates to a method to improve the potency of peptide vaccines containing MHC Class II-presented epitopes of antigens of interest to activate CD4+ immunoregulatory T cells for therapeutic or diagnostic purposes. A wide range of diseases and conditions in humans will benefit from the application of the compounds and methods of this invention to activate CD4+ immunoregulatory T cells. Such CD4+ immunoregulatory T cells can either augment or suppress the immune response to antigens of clinical interest in cancer, infectious disease, allergy, autoimmunity, graft rejection, and other clinical processes.

Antigens of clinical interest in the treatment or modification of various diseases and conditions as presented herein, are recognized by the T cells of the immune system as small peptide fragments, which are presented by Major Histocompatibility Complex (MHC) molecules on the surfaces of antigen presenting cells. MHC Class I molecules present such antigenic peptides to CD8+ cytotoxic or killer T cells. Most cells of the body express cell surface MHC Class I-presented peptides which have been drawn from the repertoire of cellular proteins and bound into the MHC Class I molecules of those cells at the time of their synthesis in the endoplasmic reticulum (the "immunological survey of self"). After viral infection or malignant transformation, the CD8+, cytotoxic T cells recognize the novel or "foreign" endogenously derived peptides in the MHC Class I molecules and kill the presenting cells.

MHC Class II molecules present antigenic peptides to CD4+ T immunoregulatory cells, which regulate the immune response by augmenting or suppressing various effector mechanisms of that response. Such effector mechanisms include, for example, cytotoxic T cell killing of target cells, antibody production by B cells and plasma cells, and dendritic cell activation. Because they regulate directly or indirectly almost all mechanisms in the immune response, CD4+ T immunoregulatory cells have been called the conductors of the immune response orchestra. MHC Class II molecules are expressed on only a subset of the cells of the body, such as macrophages, dendritic cells, and B-cells that have specialized mechanisms to internalize and process antigens of the environment. At the time of synthesis in the endoplasmic reticulum, the antigenic peptide-binding site of MHC Class II molecules is filled with the Ii protein. After transport of that complex to a post-Golgi, antigen charging compartment, the Ii protein is removed by proteases with the concerted insertion of antigenic peptides from foreign proteins, which have been internalized and processed by the antigen processing cells (Cresswell P. Cell. 1996 84:505-7; Hudson A W. Exp Cell Res. 2002 272:1-7; Bryant P W. Adv Immunol. 2002 80:71-114). The Ii-Key segment of the Ii protein interacts with an allosteric site on the MHC Class II molecule to induce lability of the antigenic peptide binding site during release of the Ii protein and binding of a selected antigenic peptide. After dissociation/destruction of the Ii-Key segment, the antigenic peptide is tightly bound in the MHC Class II molecule, for extended expression in the antigenic peptide binding site of those molecules. After transport to the cell surface, such MHC Class II-antigen peptide complexes are recognized by specialized receptors on CD4+ T immunoregulatory cells. Activation of those cells regulates the immune response in various ways, which are considered later in terms of individual therapeutic objectives. In brief, subsets of CD4+ cells may be activated along Th1, Th2, or Th2 pathways, which are characterized by differential induction of cytokines and other genes. Those regulatory cells either induce or suppress immune responses in an antigen-specific manner. Furthermore, CD4+ T cells can be induced to be a long-lived population of memory T cells.

The allosteric site at which the Ii-Key segment of the Ii protein interacts is accessible to the environment in cell surface-expressed MHC Class II molecules. This fact is of considerable value clinically because Ii-Key/antigenic epitope hybrids peptides can be administered in a simple manner in a fluid phase, for example subcutaneously, intravenously, intrathecally, intraperitoneally, transmucosally and as an aerosol to the respiratory tract, and can contact the target MHC Class II molecules without traversing membranes or undergoing any special intracellular or metabolic processing or modification. Furthermore, the fact that the allosteric site of MHC Class II molecules is expressed on the surfaces of living, or even paraformaldehyde-fixed antigen presenting cells has facilitated in vitro studies of the mechanism of action of Ii-Key peptides and of Ii-Key/antigenic epitope hybrid peptides, as presented both herein and previously in U.S. Pat. No. 5,559,028 (1996) and U.S. Pat. No. 5,919,639 (1999).

In addition to the favored property of contacting cell surface-expressed with MHC Class II molecules after a simple fluid phase administration, the Ii-Key/antigenic epitope hybrid peptides can also be taken up in an antigen processing and presenting cell, such as a macrophage or dendritic cell, and contacted to MHC Class II molecules in the course of their transversing a post-Golgi, antigen charging compartment. Selective use of either these two, very different pathways for antigen to contact MHC Class II molecules is useful during the treatment of various diseases and conditions as described herein. For example, intravenous administration at a low concentrations over a long period of time, will favor epitope presentation in a manner yielding immunosuppression, which is favored for example in the case of peptide epitopes from antigens related to multiple sclerosis or rheumatoid arthritis. Or, on the other hand, in the case of augmenting the immune response to a subsequently administered DNA vaccine for an antigen relevant to therapy of either a cancer or an infectious disease, administration of an Ii-Key/antigenic epitope incorporating an epitope coded by the DNA vaccine with an adjuvant cytokine or other stimulant promotes development of a Th1-mediated response.

The method of enhancing presentation of an MHC Class II-restricted antigenic epitope to a T lymphocyte finds wide application in the diagnosis and therapy of diseases. T cell responses to diagnostic antigenic epitopes are often measured in the diagnosis of diseases, particularly with respect to etiological infectious agents. The use of enhancing hybrids of the present invention which have such diagnostic antigenic epitopes incorporated will increase substantially the sensitivity of these in vitro diagnostic assays. In the case of infectious diseases and cancer, antigenic epitopes which are identified as pathogen or cancer specific can be incorporated into an enhancing hybrid of the present invention and the hybrid then used to initiate a Th response to a pathogen or cancer specific MHC Class II-presented antigenic epitope. This response leads to activation and expansion of T helper cells which in turn activate or 'license' dendritic cells, to prime an effective MHC Class I restricted cytotoxic T lymphocyte response toward the invading organism. In the case of autoimmune diseases, allergy, and graft rejection, specific antigenic epitopes which trigger the pathogenic immune response are identified and then incorporated into an enhancing hybrid of the present invention. The hybrid is then used to stimulate T cells in a manner leading to a Th2 response which will down regulate T cell responses. In this case, stimulation of a suppressor cell response is used to down regulate a pathogenic immune response. Methods for identifying enhancing hybrids which specifically stimulate a predetermined subset of T lymphocytes are described below. Additional methods and utilities of such hybrids in the therapy of disease are considered below.

In another aspect, the Ii-Key antigenic epitope hybrids increase the repertoire of MHC Class II alleles, and therefore the reaction of individuals in the vaccinated population who can be immunized with any given MHC Class II-presented epitope. Since the potency of an antigenic epitope presented within an Ii-Key/antigenic epitope hybrid is much larger than that of the same epitope presented as a peptide, mammals with low responder MHC Class II alleles for that given epitope may be stimulated to a level equivalent to mammals with high responder MHC Class II alleles. The development of immunoregulatory T cell clones recognizing that epitope will lead to enhanced subsequent presentation of the same epitope from an antigen of interest, for example of a malignant or virus-infected cell. This expansion of the repertoire of MHC Class II alleles promoting a therapeutic response to any one epitope, leads to a greater portion of the population being protected by immunizing with any given epitope. Thus, a "basket of peptides" vaccine, i.e., one containing peptides with various epitopes, is not needed. That is, without the use of the Ii-Key/antigenic epitope hybrid, a much larger number of individual antigenic epitope peptides must be used in a T helper peptide vaccine.

In another aspect, Ii-Key/antigenic epitope hybrids enhance responses to DNA vaccines. Vaccines containing the cDNA sequence for one or more antigens from either a pathogen or a tumor specific or tumor-associated antigen are being tested clinically. However, in many instances, high levels of protective antibodies, or long duration immunological memory, or maximal cytotoxic T cell responses, are not found. This lack of potency has been ascribed to weak helper T cell responses to such immunization. T helper cells can therefore be primed with Ii-Key/antigenic epitope hybrids to MHC Class II-presented epitopes in the cDNA vaccine in a suitable temporal schedule to maximize immunization with the cDNA vaccine.

In another aspect, addition of the Ii-Key-linker to each of a member of a library of peptides, overlapping through the sequence of an antigen of interest, increases the sensitivity of picking up MHC Class II epitopes. Given the increased potency of presentation of epitope in such hybrids, weakly antigenic epitopes, and epitopes with other limitations in inducing a particular pathway of biological response, for example those mediated by IgE, might be better recognized. Furthermore, in the case of combinatorial libraries of peptides synthesized with homology to a given experimental antigenic epitope, or a sequence only partially identified, for example by HLPC separation and tandem mass spectrography, the potency of peptides in such libraries can be enhanced by synthesizing the Ii-Key motif and linker at the N-terminus of such peptides. The fact that the synthesis of such peptides proceeds from the C- to the N-termini is favorable because either, sequentially ava, then K, then M, then R, then L (LRMK (SEQ ID NO: 8) in reverse) can be added, or Ac-LRMK-ava (SEQ ID NO: 9) can be added terminally as a unit.

In another aspect Ii-Key/antigenic epitope technology can be applied in the discovery, validation and use of cryptic antigenic epitopes. Cryptic antigenic epitopes have been defined empirically to be those epitopes, which are recognized upon immunization of a mammal with a peptide from an antigenic protein, but not upon immunization of a genetically identical mammal with the intact antigenic protein. In extensive experimental studies by Sercarz and colleagues, a procedure was established to discover most cryptic epitopes in a given antigenic protein, with respect to a given strain of mice. A library of peptides, for example each 15 amino acids in length with overlapping terminal segment of 6 amino acids, was created through the primary amino acid sequence of an antigen protein of interest, for example hen egg lysozyme. One mouse of a given strain was immunized with lysozyme and the proliferative response of splenic T cells to each of the peptides in the lysozyme library was tested. The epitopes in peptides stimulating the proliferative response were termed dominant epitopes. When additional mice of that strain were immunized with each of the respective peptides of the library of lysozyme peptides, all of the dominant epitopes were found to be immunogenic in isolated peptides, but additional epitopes were also discovered. These additional experiments were termed cryptic epitopes. Sercarz and colleagues demonstrated a series of mechanisms by which cryptic epitopes are not immunogenic when presented within the intact proteins. The clinical value of cryptic epitopes lies in part in the fact that a given individual is very unlikely to have previously recognized such epitope immunologically and therefore has not been tolerized to that epitope. Upon presentation of such cryptic epitopes within Ii-Key hybrids, therefore, a robust immune response can be developed, if the dose, route, schedule and adjuvants are designed toward that end. In the case of cancer, and even in the case of some infectious agents, tolerance can be developed to one or more epitopes, with the end result being that an effective immune response of the host is blocked. Cryptic epitope offer a novel repertoire of antigenic epitopes for such therapeutic purposes. Likewise such epitopes from allergens offer targets to develop therapeutic Th1 response while an IgE-promoting Th2 response had been developed toward dominant epitopes of the allergen. In such cases, Ii-Key/antigenic epitope hybrids containing dominant epitopes might exacerbate the pathological allergic responses.

In another aspect, the Ii-Key/antigenic epitope hybrids are favored in clinical diagnostic or therapeutic immunizations of patient for responses to epitopes in antigen of interest. That is, immunizing with Ii-Key/antigenic epitope hybrids as opposed to the epitope peptide, is favored because the dose required to obtain a clinically significant result is greatly reduced. Concomitantly the likelihood of a fatal anaphylactic response to the antigen, either in the case of an allergen, or otherwise, is reduced.

Additional assay systems can be used to measure the effect of incorporating an antigenic epitope other than a single MHC Class II epitope into an enhancing hybrid of the present invention. Assays with alternative readouts include, without limitation, measuring efficacy of immunoglobulin production from B cells, measuring efficacy of cytotoxic T cell generation, and the use of native T cells from animals which are outbred, inbred, congenic, transgenic for a T cell receptor or another biologically relevant molecule.

Methods for modulating the immune response of an individual finds application in the therapeutic treatment of an individual with a disease or condition. An antigenic epitope to which an enhanced immune response is considered to be beneficial in treatment of the patient is first selected. In one embodiment, the molecule from which the antigenic epitope is derived plays a role in pathogenesis. Alternatively, the antigenic epitope may be an epitope found on a harmful agent such as a pathogen, or on a pathogen infected cell. The term 'therapeutic treatment' as used herein is intended to include ameliorating the signs or symptoms of disease, or arresting the progression of disease in an individual identified or considered to be suffering from a disease. The term 'prevention' as used herein is intended to include ameliorating the underlying cause to, or associated factor predisposing to, a disease, in an individual who might not have begun to experience recognizable signs or symptoms of a disease.

The disease may be an infectious disease caused or associated with infection by a bacterium, a virus, a parasite, a fungus, a *rickettsia*, or other infectious agent, or combination of such agents. The therapy may be directed against the toxin of a disease or against a receptor for a toxin of a disease. Preferred toxins for epitope derivation include, without limitation, staphylococcal enterotoxins, toxic shock syndrome toxin, retroviral antigens (e.g. antigens derived from human immunodeficiency virus), streptococcal antigens, mycoplasma, mycobacterium, and herpes viruses. Highly preferred toxins are anthrax toxin (lethal factor, edema factor and protective antigen), SEA, SEB, $SE_{1-3}$, SED and SEE.

The disease or condition may be considered to be an autoimmune process, for example rheumatoid arthritis, multiple sclerosis, lupus erythematosus, diabetes mellitus, myasthenia gravis, autoimmune thyroiditis, scleroderma, dermatomyositis, pemphigus, and other similar processes. Examples of such model systems for autoimmune diseases which can be used to evaluate the effects of the compounds and methods of the present invention are systemic lupus erythematosus, myasthenia gravis, rheumatoid arthritis, insulin dependent diabetes mellitus, and experimental allergic encephalomyelitis. The procedures for conducting these experiments are presented in Clark et al., (1994) U.S. Pat. No. 5,284,935, the contents of which are incorporated herein by reference.

The disease or condition may be considered to be an allergic process, for example asthma, hayfever, allergic rhinitis, topical dermatitis, colitis, and other such processes initiated or associated with particular allergens or no defined allergen. Examples of such allergens are plant, animal, bacterial, parasitic allergens and metal-based allergens that cause contact sensitivity. Preferred allergens for use in the present invention are weed, grass, peanut, mite, flea and cat antigens.

Alternatively, the disease or condition may be a proliferative or malignant process, for example cancer, benign prostatic hypertrophy, psoriasis, adenomas or other cellular proliferations of intrinsic origin, or in response to a viral or other infectious, irritative, or environmental process.

The term 'mammal' as used herein is meant to encompass the human species as well as all other mammalian species. The compounds and methods of this invention may be applied in the treatment of diseases and conditions occurring in individuals of all mammalian species. The term 'individual' as used herein refers to one of any mammalian species, including the human species. The diseases and conditions occurring in individuals of the human species, and mentioned herein by way of example, shall include comparable diseases or conditions occurring in another species, whether caused by the same organism or pathogenic process, or by a related organism or pathogenic process, or by unknown or other known, organism and/or pathogenic process. The term 'physician' as used herein also encompasses veterinarians, or any individual participating in the diagnosis and/or treatment of an individual of a mammalian species.

The present invention also provides for the administration of a compound, as a drug, a prodrug of the compound, or a drug-metabolite of the compound, in a suitable pharmaceutical formulation. The terms 'administration of' or 'administering a' compound is understood to mean providing a compound of the invention, as a drug, a prodrug of the compound, or a drug-metabolite of the compound, to an individual in need of treatment or prevention of a disease. Such a drug which contains one or more of the hybrid polypeptides of the present invention, as the principal or member active ingredient, for use in the treatment or prevention of one or more of the above-noted diseases and conditions, can be administered in a wide variety of therapeutic dosage forms in the conventional vehicles for topical, oral, systemic, and parenteral administration. The route and regimen of administration will vary depending upon the disease or condition to be treated, and is to be determined by the skilled practitioner. For example, the compounds can be administered in such oral dosage forms for example as tablets, capsules (each including timed release and sustained release formulations), pills, powders, granules, elixirs, tinctures, solutions, suspensions, syrups and emulsions, or by injection. Likewise, they may also be administered in intravenous (either by bolus or infusion methods), intraperitoneal, subcutaneous, topical with or without occlusion, or intramuscular form. All of these forms are well known to those of ordinary skill in the pharmaceutical arts.

The daily dose of the products may be varied over a range from 0.001 to 1,000 mg per adult per day. For oral administration, the compositions are preferably provided in the form of tables containing from 0.001 to 1,000 mg, preferably 0.001, 0.01, 0.05, 0.1, 0.5, 1.0, 2.5, 10.0, 20.0, 50.0, 100.0 milligrams of active ingredient for the symptomatic adjustment of dosage according to signs and symptoms of the patient in the course of treatment. An effective amount of drug is ordinarily supplied at a dosage level of from about 0.0001 mg/kg to about 50 mg/kg of body weight per day. The range is more particular from about 0.0001 mg/kg to 7 mg/kg of body weight per day.

Advantageously, suitable formulations of the present invention may be administered in a single daily dose, or the total daily dosage may be administered in divided doses for example of two, three, or four times daily. The enhancing hybrid polypeptide of the present invention may be used to prepare a medicament or agent useful for the treatment of the diseases or conditions listed above. Furthermore, compounds of the present invention can be administered in intranasal form via topical use of suitable intranasal vehicles, or via transdermal routes, using those forms of transdermal skin patches well known to those of ordinary skill in the art. To be administered in the form of a transdermal delivery system, the dosage administration will, or course, be continuous rather than intermittent throughout the dosage regimen.

For treatment and prevention of disease, the hybrid polypeptide of the present invention may be administered in a pharmaceutical composition comprising the active compound in combination with a pharmaceutically acceptable carried adopted for topical administration. Topical pharmaceutical compositions may be, for example, in the form of a solution, cream, ointment, gel, lotion, shampoo, or aerosol formulation adapted for application to the skin. These topical pharmaceutical composition containing the compounds of the present invention ordinarily include about 0.005% to 5% by weight of the active compound in admixture with a pharmaceutically acceptable vehicle.

For the treatment and prevention of disease and conditions, for example listed above, the hybrid polypeptide of the present invention may be used together with other agents known to be useful in treating such diseases and conditions. For combination treatment with more than one active agent, where the active agents can be administered concurrently, the active agents can be administered concurrently, or they can be administered separately at staggered times.

The dosage regimen utilizing the compositions of the present invention is selected in accordance with a variety of factors, including for example type, species, age, weight, sex and medical condition of the patient, the severity of the condition to be treated, and the particular compound thereof employed. A physician of ordinary skill can readily determine and prescribe the effective amount of the drug required to prevent, counter, or arrest the progress of the disease or condition. Optimal precision in achieving concentration of drug with the range that yields efficacy either without toxicity or with acceptable toxicity requires a regimen based on the kinetics of the drug's availability to target sites. This process involves a consideration of the distribution, equilibrium, and elimination of the drug, an is within the ability of the skilled practitioner.

In the methods of the present invention, the compounds herein described in detail can form the active ingredient and are typically administered in admixture with suitable pharmaceutical diluents, excipients or carders (collectively referred to herein as 'carder materials') suitably selected with respect to the intended form of administration, that is, oral tablets, capsules, elixirs, syrups, and the like, and consistent with conventional pharmaceutical practices. For instance, for oral administration in the form of a tablet or capsule, the active drug component can be combined with an oral, non-toxic pharmaceutically acceptable inert carrier such as ethanol, glycerol, water and the like. Moreover, when desired or necessary, suitable binders, lubricants, disintegrating agents and coloring agents can also be incorporated into the mixture. Suitable binders include, without limitation, starch, gelatin, natural sugars such as glucose or beta-lactose, corn sweeteners, natural and synthetic gums such as acacia, tragacanth or sodium alginate, carboxymethyl cellulose, polyethylene glycol, waxes and the like. Lubricants used in these dosage forms include, without limitation, sodium oleate, sodium stearate, magnesium stearate, sodium benzoate, sodium acetate, sodium chloride and the like. Disintegrators include, without limitation, starch, methyl cellulose, aga, bentonite, xanthan gum and the like.

The liquid forms may be suitably flavored suspending or dispersing agents such as the synthetic and natural gums, for example, tragacanth, acacia, methyl cellulose and the like. Other dispersing agents which may be employed are glycerin and the like. For parental administration, sterile suspensions an solutions are desired. Isotonic predations which generally contain suitable preservatives are employed when intravenous administration is desired.

Topical preparations containing the active drug component can be admixed with a variety of carrier materials well known in the art, such as, for example, alcohols, aloe vera gel, allatoin, glycerine, vitamins A or E oils, mineral oil, PPG2 myristyl propionate, and the like, to form, for example, alcoholic solutions, topical cleansers, cleansing creams, skin gels, skin lotions, and shampoos in cream or gel formulations.

The hybrid polypeptide of the present invention can also be administered in the form of liposome delivery systems, such as small unilamellar vesicles, large unilameller vesicles and multilamellar vesicles. Liposomes can be formed from a variety of compounds, including for example cholesterol, stearylamine, and various phosphatidylcholines.

The hybrid polypeptide or formulation thereof of the present invention may be coupled to a class of biodegradable polymers useful in achieving controlled release of a drug, for example, polylactic acid, polyepsilon caprolactone, polyhydroxy butyric acid, polyorthoesters, polyacetals, polydihyrdo-pyrans, polycyanoacrylates, and cross-linked or amphipathic block copolymers of hydrogels.

The hybrid polypeptides of the present invention and formulations thereof can be prepared using readily available starting materials, reagents and conventional synthesis procedures. In these reactions, it is also possible to make use of variants which are themselves known to those of ordinary skill in this art, but are not mentioned in greater detail herein.

As an alternative to administering the enhancing hybrid of the present invention directly to an individual to enhance the MHC Class II presentation of an antigenic epitope to T lymphocytes of the individual, a population of antigen presenting cells may be obtained from the individual and treated ex vivo with the enhancing hybrid of the present invention. These cells are treated with the enhancing hybrid under conditions appropriate for binding of the hybrid to an MHC Class II molecule of the antigen presenting cells. Once treated, the antigen presenting cells are administered to the individual under conditions which promote physical contact of the treated cells with T lymphocytes of the individual. As described above, the effect on the immune response, enhancement or suppression, will depend upon which subset of T cells are preferentially stimulated by the enhancing hybrid. Enhancement of the immune response may have a favorable effect upon the cytotoxic response against, for example, either a cancer cell or an infectious organism. Alternately, enhancement of the T suppressor cell response may have the effect of suppressing the immune response to a specific molecule. Such suppression may have a therapeutic effect when utilizing antigenic epitopes from etiological antigens of autoimmune diseases, for example, rheumatoid arthritis, multiple sclerosis, myasthenia gravis, or lupus erythematosus. The methods and procedures for the ex vivo treatment of cells from a patient with the compounds and methods of the present invention may be adapted from the following patents, the contents of which are incorporated herein by reference: Rosenberg (1998) U.S. Pat. No. 5,126,132; Chada et al., (1997) U.S. Pat. No. 5,693,522; Kriegler et al., (1998) U.S. Pat. No. 5,849,586; Gruber et al., (1999) U.S. Pat. No. 5,856,185; and Kriegler et al., (1999) U.S. Pat. No. 5,874,077.

In another respect, the compounds and methods of the present invention can be used under ex vivo conditions to promote the generation of cytotoxic T lymphocytes, using the compounds and methods described in Celis et al., (1998) U.S. Pat. No. 5,846,827, the contents of which are incorporated herein by reference.

As discussed above, a non-comprehensive discussion of specific examples of epitopes/determinants useful as elements in the enhancing hybrids of the present invention is provided in the Exemplification section. Also found in the corresponding Exemplification section is a discussion of methods for using an enhancing hybrid containing such an element. One skilled in the art, through the application of no more than routine experimentation, can incorporate experimentally-determined or predicted epitopes/determinants into an enhancing hybrid for application to a wide range of disease or conditions.

In another aspect this invention relates to a method to identify and exploit naturally occurring Ii-Key/MHC Class II antigenic epitopes which have in the sequence a primary sequence motif which functions during the processing and binding of such peptides to MHC Class II molecules in the classical exogenous pathway, as does the synthetic Ii-Key/ antigenic epitope hybrids.

Given the identification of the presence or absence of such Ii-Key motifs comprising, one can modify the amino acid sequence of the protein in a manner to introduce such a motif when one was not present, or to delete such a motif when one was present. Such modifications are obtained for example trough manipulation of the genes coding of the antigenic protein in a manner to substitute a functionally accepted amino acid in the Ii-Key motif. In some instances a deletion or insertion of amino acids can obtain the same end, for example when the antigenic epitope occurs at or near the N-terminus of the protein. Such modifications to change the immunogenecity of the protein have favorable clinical properties. For example, vaccine promoters can behave increased potency. Certain therapeutic proteins can have decrease immunogenecity.

In another aspect, the present invention relates to methods for selecting biologically active MHC Class II-presented epitopes and altering the immune response to such epitopes in antigenic proteins or polypeptides. Specifically, this disclosure provides method to identify in the amino acid sequence of a protein the presence or absence of a Ii-Key immunoregulatory motif of 5 amino acids preceding an experimentally determined or algorithm-predicted, MHC Class II-presented, antigenic epitope. This immunoregulatory Ii-Key motif enhances charging of the antigenic epitope, which follows it into the antigenic peptide binding site of MHC Class II molecules. Given predictions of antigenic epitopes within a protein, identifying the subset of those epitopes preceded by an Ii-Key motif improves greatly the efficiency of vaccine peptide selection. Also, by modifying the sequence of a protein or polypeptide, for example, either to introduce or to eliminate an Ii-Key motif before selected MHC Class II-presented epitopes, the immunological response to that protein can be altered.

Adverse immunological responses to a therapeutic protein can limit the use of such a protein. Such adverse immunological responses can be lessened either by decreasing immunogenecity of some of the MHC Class II-presented epitopes or by inducing immunosuppression. For either case, insertion or alteration(s) at the location of an Ii-Key motif appropriately spaced before an MHC Class II epitope can achieve that endpoint without alteration of the MHC Class II epitope itself. It may not be possible to alter residues within the MHC Class II-epitope without loss of the biological function of the therapeutic protein. The following procedure is followed in designing sequence modifications in a therapeutic protein of interest to alter its immunogenecity and/or the immune response to that protein.

The sequence of a protein, or a fragment thereof, is established by one of several methods. The protein or fragment thereof can be experimentally sequenced, or the sequence can be deduced from either the sequence of either the gene coding for the protein or a cDNA created from the RNA coding for the protein. Given that primary amino acid sequence, the experimentally determined or algorithm-predicted MHC Class II epitopes are specified. The experimentally determined epitopes are known from prior investigations. The algorithm-predicted epitopes are found by several methods, such as the ProPred MHC Class-II Binding Peptide Prediction Server (Raghava G P. Nat Biotechnol. 1999 17:555-61); Singh, H. Bioinformatics 2001 17:1236-7 (access via: www.imtech.res.in/raghava/propred/index.html)). An alternative program is the SYFPEITHI program (Rammensee H-G. Immunogenetics 1999 50: 213-219 (access via: 134.2.96.221/scripts/MHCServer.dll/Ep.html)). These epitopes are also characterized with respect to the MHC Class II alleles, which are either known or predicted to present them to the immune system of humans or an experimental animal such as the mouse. Thus, differing sets of predicted epitopes are obtained, according to the relevant presenting MHC Class II allele. Some epitopes are presented by multiple MHC Class II alleles and are, therefore, preferred.

This disclosure presents a method for the identification of an Ii-Key immunoregulatory motif. Specifically, in the sequence of a protein, the immunoregulatory, Ii-Key motif is a segment of 5 contiguous amino acids containing at least two amino acids of the group comprising Leu, Ile, Val, Phe, and Met, and at least one of the group comprising His, Lys, and Arg, where that contiguous 5 amino acid segment is separated by 5 to 11 amino acids from the N-terminal residue of the MHC Class II-presented epitope.

The subset of such antigenic epitopes with the presence of an appropriately spaced Ii-Key motif lead to vaccine peptides to enhance the potency of the CD4+ T cell immune response. Such epitopes are considered to be more likely to be dominant or biologically active. Peptides with such epitopes are favored as vaccine protect against infectious diseases and cancer, and to immunosuppressive vaccines to allergy. The compositions and methods of the present invention relate to non-naturally occurring proteins or polypeptides which contain: 1) a C-terminal element comprising an MHC Class II-presented epitope; 2) an N-terminal element comprising an Ii-key motif; and 3) an intervening element comprising a sequence from about 4 to about 11 amino acid residues. The use of the term non-naturally occurring is intended to require that the protein or polypeptide is modified. Generally, the modification is by recombinant DNA techniques, and the modification or modifications take place within elements 2) or 3) as defined above. The designations "N- and C-terminal" are meant to refer only to the relationship of these elements in the 3-part segment specifically recited. One of skill in the art will recognize that if such a 3-part segment is located within a protein, it is likely that additional residues will extend in the C-terminal direction from the C-terminal element, and in the N-terminal direction from the N-terminal element. In addition to proteins or polypeptides as described above, the present application is also directed toward expressible nucleic acid sequences which encode such proteins or polypeptides.

In preferred embodiments, the non-naturally occurring protein or polypeptide is a modified form of a naturally occurring protein or polypeptide. Therapeutic proteins represent a particularly important class. Such modified proteins or polypeptides stimulate an immune response which differs from that induced by their non-modified, naturally-occurring counterparts. Such products include therapeutic proteins, such as hormones, cytokines, or other molecules interacting with cell surface receptors. Modifications of an Ii-Key motif can be made to eliminate its function, or a site N-terminal to a putative antigenic epitope can be modified to introduce an Ii-Key motif. Such modifications suppress a deleterious immune response to the therapeutic protein. Such products include the therapeutic protein, and fragments thereof, and genetic constructs leading to their expression.

Modifications most likely not to disturb the biological function of a therapeutic protein to be engineered to alter immunogenecity include the following. Presence is scored of sequences, and even individual amino acid residues, which are known from the crystallographic structure of the protein to be superficially exposed on the protein, and thus more likely to accept a mutation without loss of function. In the case of therapeutic proteins for which the three dimensional structure has not been determined, various methods are applied to predicting acceptance of mutations to engineer an Ii-Key box appropriately spaced from an antigenic epitope. Distances from the N-terminus and from the C-terminus of the protein are determined. Upon modestly denaturing conditions, N-terminal and C-terminal antigenic epitopes can be presented by MHC Class II molecules. Epitopes at the N-terminus of the protein are favored over epitopes at the C-terminus, in part because the to-be-designed Ii-Key box is more distal. Also sequence alterations are more likely to be accepted in a sequence, which is predicted to be on the surface of the protein, preferably in relatively loose configuration. Such segments can be identified in homologous proteins with a relatively higher frequency of naturally occurring mutations. Segments are identified containing residues, which in site-directed mutational studies, have been shown to accept amino acid substitutions. By the preceding and additional methods, one skilled in the art will predict segments of a protein that are more likely to accept without loss of function, amino acid substitutions at residue positions resulting in the creation of Ii-Key box motifs at appropriate N-terminal displacements from the N-terminus of an antigenic epitope. The following peptide sequences are targeted for Ii-Key box manipulations, in rank order: epitopes known to be MHC Class II-presented, epitopes predicted to be MHC Class II-presented by MHC Class II alleles present either in the highest frequency among humans or in the animal strain of experimental interest. Some of these methods are presented in U.S. Pat. No. 5,679,527 (1997), the content of which is incorporated herein by reference.

In addition to the above site-specific engineered replacements, one skilled in the art will use additional combinatorial molecular biological methods to generate mutations within sets of residue positions to create an Ii-Key box motif spaced 4 to 8 amino acids N-terminal to a selected, either known or putative antigenic epitope. Such methods may encompass the preparations of multiple products, which are screened for altered immunogenecity with or without retention of biological activity.

Each experimentally determined or algorithm-predicted epitope in the protein of interest is examined for the presence in its primary sequence of a segment of 5 contiguous amino acids containing at least two amino acids of the group comprising Leu, Ile, Val, Phe, and Met, and at least one of the group comprising His, Lys, and Arg, where that contiguous 5 amino acid segment is separated by 4 to 12 amino acids from the N-terminal residue of a MHC Class II-presented epitope. The subset of all experimentally or algorithm-predicted epitopes meeting these criteria are preferred for developmental work, including for example synthesis of peptide vaccines, chemical modifications of those vaccines for a favorable therapeutic effect, experimental study in animals, and clinical studies. In this disclosure the standard single letter nomenclature of the International Union of Pure and Applied Chemists is used to identify amino acids within the sequence of proteins or peptides.

More preferable is the set of experimentally or algorithm-predicted epitopes with a 4 to 8 amino acids separation from the N-terminal residue of the MHC Class II-presented epitope, of the segment of 5 contiguous amino acids containing at least two amino acids of the group comprising Leu, Ile, Val, Phe, and Met, and at least one of the group comprising His, Lys, and Arg. This set constitutes a subset of the set of experimentally or algorithm-predicted epitopes with a 0 to 12 amino acids separation from the N-terminal residue of the MHC Class II-presented epitope, of the segment of 5 contiguous amino acids containing at least two amino acids of the group comprising Leu, Ile, Val, Phe, and Met, and at least one of the group comprising His, Lys, and Arg. An important utility in this method is the reduction in the number of candidate epitopes subject to study toward therapeutic or diagnostic development objectives. In each of the Exemplification Tables of this disclosure presenting either experimentally determined or algorithm-predicted epitopes, the presence of an Ii-Key box separated by 4-10 amino acids from the N-terminus of the MHC Class II-presented epitope is indicated, with the number of intervening residue positions. Among these, preference is ranked according to the length of the separating interval, with shorter being better, among spacers of 4 or more amino acids.

Peptides which are chosen for synthesis have within the natural primary sequence of the protein, an MHC Class II-presented epitope and a segment of 5 contiguous amino acids containing at least two amino acids of the group comprising Leu, Ile, Val, Phe, and Met, and at least one of the group comprising His, Lys, and Arg, the intervening segment of 0 to 12 amino acids, and the antigenic epitope, comprising a total length of 12 to 34 amino acids. More preferred is a synthetic peptide synthesized according to the primary sequence of the protein, including the segment of 5 contiguous amino acids containing at least two amino acids of the group comprising Leu, Ile, Val, Phe, and Met, and at least one of the group comprising His, Lys, and Arg, the intervening segment of 4 to 11 amino acids, and the antigenic epitope, comprising a total length of 15 to 25 amino acids. The sequence of the synthetic peptide will usually be the natural sequence of a mammalian protein, but also the protein may be a non-natural sequence, such as that generated by methods using a combinatorial library with selections for a useful function. Furthermore, the sequence of the protein may include modifications of the sequence of natural protein, including for example substitution, insertion, or deletion of one or more amino acids, including the use of non-natural amino acids.

The selected peptides, including the segment of 5 contiguous amino acids containing at least two amino acids of the group comprising Leu, Ile, Val, Phe, and Met, and at least one of the group comprising His, Lys, and Arg, the intervening segment of 4 to 8 amino acids, and the antigenic epitope, comprising a total length of 12 to 34 amino acids will be modified to obtain favorable biological and pharmacokinetic properties. These medications are selected from the group consisting of: a) acetylation of the N-terminus, b) amidation of the C-terminus; c) replacement of an amino acid with another natural or synthetic amino acid, d) replacement of an L-amino acid with a D-amino acid, e) inversion of the amino acid sequence and use of D-amino acids in each residue positions, f) modifications to limit proteolysis or clearance (inactivation), and g) modifications to improve solubility, transport and half-life. Methods of chemical modification of therapeutic peptides for favorable therapeutic properties are presented, for example, in U.S. Pat. No. 5,679,527, the disclosure of which is incorporated herein by reference.

The method to design such modifications start with a list of identified epitopes, ranked according to each of several characteristics in order to identify segments of the therapeutic protein, which are more likely to accept without loss of function, amino acid substitutions which create an Ii-Key box motif appropriately spaced from the N-terminus of an antigenic epitope. The characteristics by which the epitopes are ranked include, without limitation, the following. Presence is scored of sequences, and even individual amino acid residues, which are known from the crystallographic structure of the protein to be superficially exposed on the protein, and thus more likely to accept a mutation without loss of function. In the case of therapeutic proteins for which the three dimensional structure has not been determined, various methods are applied to predicting acceptance of mutations to engineer an Ii-Key box appropriately spaced from an antigenic epitope. Distances from the N-terminus and from the C-terminus of the protein are determined. Upon modestly denaturing conditions, N-terminal and C-terminal antigenic epitopes can be presented by MHC Class II molecules. Epitopes at the N-terminus of the protein are favored over epitopes at the C-terminus, in part because the to-be-designed Ii-Key box is more distal. Presence in a sequence motif, which is predicted to be on the surface of the protein, preferably in relatively loose configuration. Segments are identified which in homologous proteins have a relatively higher frequency of naturally occurring mutations. Segments are identified containing residues, which in site-directed mutational studies have been shown to accept amino acid substitutions. By the preceding and additional methods, one skilled in the art will predict segments of a protein which are more likely to accept without loss of function, amino acid substitutions at residue positions which create Ii-Key box motifs at appropriate N-terminal displacements from the N-terminus of an antigenic epitope which is highly ranked according to the following ranking scheme: epitopes known to be MHC Class II-presented, epitopes predicted to be MHC Class II-presented by MHC Class II alleles present either in the highest frequency among humans or in the animal strain of experimental interest. Some of these methods are presented in U.S. Pat. No. 5,679,527 (1997) the disclosures of which are incorporated herein by reference.

The Ii-Key box/spacer identifying algorithm is applied within the amino acid sequence of the protein to examine regions N-terminal to each of the above experimentally determined or predicted MHC Class II-presented epitopes, in a manner to identify three categories: a) presence of an Ii-Key box motif spaced by 4 to 8 amino acids, N-terminal to the antigenic epitope, b) presence of an Ii-Key box motif spaced by 4 to 8 amino acids, N-terminal to the antigenic epitope if one or more amino acids were exchanged for a member of the group Leu, Ile, Val, Phe, Met and/or one or more amino acids were exchanged for a member of the group His, Lys and Arg in the primary sequence.

In addition to the above site-specific engineered replacements, one skilled in the art will use additional combinatorial molecular biological methods to generate mutations within sets of residue positions to create an Ii-Key box motif spaced 4 to 8 amino acids N-terminal to a selected, either known or putative antigenic epitope. Such methods may encompass the preparations of multiple products, which are screened for altered immunogenecity with or without retention of biological activity.

Many uses of Ii-Key antigenic epitope hybrids can be described with respect to individual antigenic proteins. Such uses are presented in the Examples, in varying degrees of detail. The concepts, which are presented in the context of one Example, apply nevertheless in the cases of all Examples when appropriate, even when they are not repeated in the context of each individual Example. While such specific examples well present methods to design and synthesize Ii-Key antigenic epitope hybrids of specific proteins by which such Ii-Key antigenic epitope hybrids can be created and used with respect to other proteins of interest, as the need might arise from to time.

In another aspect, this invention relates to the use of Ii-Key/antigenic epitope hybrids to enhance protective immune responses to a subsequently administered DNA vaccine or against an attenuated infectious pathogen vaccine. Such adjuvant vaccine preparations can be referred to as PreVaccines™. One example is the use of Ii-Key antigenic epitope hybrids in vaccination protocols to protect against variola. Uses in protecting against smallpox virus are considered in relatively greater detail in a corresponding section of the Exemplification section which follows. Considerations detailed herein also serve to model applications directed toward other pathogens. In the case of smallpox vaccination, Ii-Key antigenic epitope hybrids are used to elicit a Th1 response to one or more MHC Class II-presented epitopes of the gp42 extracellular envelope protein coded by the B5R viral gene of vaccinia. Individuals so vaccinated will have an anamnestic response which is more rapid and of higher potency in terms of antibody titers and isotype an affinity maturation, CTL and memory responses to challenge by cDNA vaccines for the B5R gene, by vaccinia, or by variola. In a related application, such PreVaccines™ can be used before vaccination with recombinant vaccinia virus containing either Ii-RGC genes or CIITA plus Ii-RGC genes. The recombinant vaccinia virus containing an Ii-RGC gene, upon infection within a professional antigen presenting cell such as a dendritic cell, will lead to MHC Class II-restricted T helper cell responses in those cells as described. In the case of recombinant vaccinia virus containing both an Ii-RGC gene and a CIITA gene, such a virus upon infecting cells which do not normally express MHC Class II molecules, such as dendritic cells, will express MHC Class II molecules without Ii protein. A wide repertoire of MHC Class II-presented epitopes are thus represented and the response to those epitopes is further enhanced by prior expansion of responses to the MHC Class II epitope in the PreVaccine™. Such a use can be further augmented by prior immunization of mammals with Ii-Key antigenic epitope hybrids in an appropriate dose, vehicle, route and schedule. Ii-Key/antigenic epitope hybrids can thus be used either as a stand-alone protective vaccine or as a PreVaccine™ used in conjunction with vaccines for other viruses and infectious pathogens, for example, without limitation, HIV, *Bacillus anthracis*, EBOLA virus and Marburg virus.

EXEMPLIFICATION

Example 1

Ii-Key/Ara h 1 Antigenic Epitope Hybrids

In one aspect this invention relates to therapeutic modulation of pathological allergic responses of some humans to peanuts and other edible nuts. Such responses include potentially fatal asthmatic or anaphylactic reactions. Good progress has been made in identifying and sequencing the principal protein allergens in peanuts and other nuts mediating these pathological responses. Crossed-radioimmunoelectrophoresis has identified 16 allergenic fractions in raw peanut and sodium dodecylsulfate polyacrylamide gel electrophoresis has revealed 32 protein bands (Barnett D. J Allergy Clin Immunol. 1983 72:61-68). Three major allergens have been identified. Ara h 1 of 64.5 kDa is a member of the vicilin family of seed storage proteins (Burks A W. J Allergy and Clin Immunol. 1991 88:172-9). Ara h 2 of 17.5 kDa is a member of the conglutin family of seed storage proteins (Burks A W. J Allergy and Clin Immunol. 1992 90:962-9). Ara h 3 of 60 kDa, a preproglobulin, is a member of the glycinin-like seed storage proteins (Rabjohn P. J Clin Invest. 1999 103:535-42). For Ara h 1, 23 IgE-recognized epitopes have been mapped, with 4 being dominant. For Ara h 2, 10 IgE-recognized epitopes have been mapped, with 3 being dominant. For Ara h 3, 4 IgE-recognized epitopes have been mapped, with 1 being dominant. For each of these three allergens, the respective cDNAs have been isolated and expressed. The deduced protein sequences are presented below (Tables 1.1, 2.1 and 3.1).

Development of allergy-inducing IgE antibodies is regulated by a subset of CD4+ T cells, the receptors of which recognize antigenic peptides presented by MHC Class II-molecules. The recognition of such epitopes by CD4+ T cells can lead either to a Th1 response, in which the responding T cells are characterized by synthesis of predominantly certain cytokines such as IFN-γ, or to a Th2 response, in which the responding T cells are characterized by synthesis of predominantly other cytokines such as IL-4 and IL-10. In patients with allergen-induced asthma, a Th2 pattern of response enhances synthesis of IgE molecules recognizing many different surface epitopes of the offending allergen(s). Binding of IgE to such allergens activates a cascade of biological mediators resulting in the asthmatic symptoms. The compounds and methods of the invention can be applied to the modification of responses in a Th1 or Th2 pathway-specific manner to obtain clinically desired effects. Such modifications can be illustrated for the control of asthma.

In animal studies of asthmatic allergic responses to protein antigens, it was discovered that substitution of one or more amino acids within the MHC Class II antigenic epitope leads to potential therapeutic agents inducing an altered T cell immune response. Specifically, such altered antigenic peptides modified a predominantly Th2 response, which promotes asthmatic responses, to a predominantly Th1 response (Janssen E. J. Immunol. 2000 164:1580-8; Janssen E M. J Immunol. 2000 165:7207-14). Such immunodeviation from a Th2 to a Th1 pattern functionally suppresses the asthmatic response. However replacement of individual amino acids in a MHC Class II-presented epitope of an offending allergen is expected to alter potency of binding of the antigenic peptides in the antigenic peptide binding site as well as the repertoire of T cell receptors responding to the antigenic peptide. Affinity of the antigenic epitope peptide for a patient's MHC Class II alleles can be decreased by such structural manipulations. One significant advantage of the method of this invention is the ability to immunodeviate the pattern of Th subset activation from the Th2 pathway to the Th1 pathway, without changing the sequence of the antigenic epitope. Since MHC Class II molecules demonstrate allele-specific preferences for some antigenic peptides and not for other antigenic peptides (which might nevertheless be well presented by other MHC Class II alleles), there is no issue of potentially decreased potency of Ii-Key/antigenic epitope hybrids. In fact, given the increase in potency of presentation of epitopes within Ii-Key/antigenic epitope hybrids, one can expect presentation by a wider range of MHC Class II alleles. Another clinically preferred characteristic of the Ii-Key/antigenic epitope hybrids over sequence-modified antigenic epitope peptides is that the dose required to achieve immunodeviation is much less (by a factor of 10 to 100) and therefore potentially fatal anaphylaxis is much less likely to occur.

In another aspect, this invention relates to the design of Ii-Key/Ara h 1 antigenic epitope hybrids. Such Ii-Key/Ara h 1 antigenic epitope hybrids comprise the Ii-Key motif LRMK (SEQ ID NO: 3) and acceptable modifications, linked through a simple, flexible linker to a MHC Class II-presented epitopes of the Arachis hypogaea 1 (Ara h 1) major allergen protein found in peanuts and some additional edible nuts. The amino acid sequence of this allergen (626 amino acids) is presented in Table 1.1. The sequence of Ara h 1 was taken from GenBank entry gi/11683gi/ allergen Ara h 1. MHC Class II-presented epitopes within this protein sequence were identified with the Singh ProPred MHC Class-II Binding Peptide Prediction Server (Raghava G P. Nat Biotechnol. 1999 17:555-61; Singh, H. Bioinformatics 2001 17:1236-7 (access via: www.imtech.res.in/raghava/propred/index.html)). The ProPred program evaluates sequences for presentation by many common MHC Class II alleles. An alternative program is the SYFPEITHI program (Rammensee H-G. Immunogenetics 1999 50: 213-219 (access via: www.uni-tuebingen.de/uni/kxi/)). Epitopes with highest scores were identified for their presentation by 51 HLA-DR alleles that cover more than 90% of the MHC Class II alleles. The highest scoring epitopes predicted with the ProPred program are likely to be experimentally antigenic. The peptides listed in Table 1.2 have the highest scoring epitopes, in the ProPred program analysis for Ara h 1. Ii-Key/Ara h 1 hybrids containing some of the predicted MHC Class II-presented Ara h 1 epitopes of Table 1.2 are listed in Table 1.3. Experimentally defined IgE-binding Ara h 1 epitopes which overlap with predicted MHC Class II-presented Ara h 1 epitopes are listed in Table 1.4. Ii-Key/Ara h 1 hybrids containing predicted MHC Class II Ara h 1 epitopes and experimentally determined IgE-binding Ara h 1 epitopes are listed in Table 1.5.

TABLE 1.1

(SEQ ID NO: 10)
Deduced amino acid sequence of Ara h 1.

```
  1 mrgrvsplml llgilvlasv sathaksspy qkktenpcaq rclqscqqep
 51 ddlkqkaces rctkleydpr cvydprghtg ttnqrsppge rtrgrqpgdy
101 dddrrqprre eggrwgpagp rerereedwr qpredwrrps hqqprkirpe
151 gregeqewgt pgshvreets rnnpfyfpsr rfstrygnqn grirvlqrfd
201 qrsrqfqnlq nhrivqieak pntlvlpkha dadnilviqq gqatvtvang
251 nnrksfnlde ghalripsgf isyilnrhdn qnlrvakism pvntpgqfed
301 ffpassrdqs sylqgfsrnt leaafnaefn eirrvlleen aggeqeergq
351 rrwstrssen negvivkvsk ehveeltkha ksvskkgsee egditnpinl
401 regepdlsnn fgklfevkpd kknpqlqdld mmltcveike galmlphfns
451 kamvivvvnk gtgnlelvav rkeqqqrgrr eeeededeee egsnrevrry
501 tarlkegdvf impaahpvai nasselhllg fginaennhr iflagdkdnv
551 idqiekqakd lafpgsgeqv ekliknqkes hfvsarpqsq sqspsspeke
601 spekedqeee nqggkgplls ilkafn
```

TABLE 1.2

Predicted MHC Class II-presented epitopes of Ara h 1.

| PEPTIDE NO: | Pos. | Sequence | Score | Ii-Key | SEQ ID NO: |
|---|---|---|---|---|---|
| 1.2.1 | 417 | V K P D K K N P Q | 6.00 | — | 11 |
| 1.2.2 | 193 | I R V L Q R F D Q | 6.00 | — | 12 |
| 1.2.3 | 313 | L Q G F S R N T L | 6.00 | — | 13 |

TABLE 1.2-continued

Predicted MHC Class II-presented epitopes of Ara h 1.

| PEPTIDE NO: | Pos. | Sequence | Score | Ii-Key | SEQ ID NO: |
|---|---|---|---|---|---|
| 1.2.4 | 453 | M V I V V V N K G | 6.00 | 3 | 14 |
| 1.2.5 | 457 | V V N K G T G N L | 5.20 | — | 15 |
| 1.2.6 | 498 | V R R Y T A R L K | 5.30 | — | 16 |
| 1.2.7 | 209 | L Q N H R I V Q I | 5.30 | 8 | 17 |

TABLE 1.2-continued

Predicted MHC Class II-presented epitopes of Ara h 1.

| PEPTIDE NO: | Pos. | Sequence | Score | Ii-Key | SEQ ID NO: |
|---|---|---|---|---|---|
| 1.2.8 | 206 | F Q N L Q N H R I | 4.40 | 5 | 18 |
| 1.2.9 | 9 | M L L L G I L V L | 5.30 | 3 | 19 |
| 1.2.10 | 11 | L L G I L V L A S | 5.50 | 4 | 20 |
| 1.2.11 | 1 | M R G R V S P L M | 4.25 | — | 21 |
| 1.2.12 | 15 | L V L A S V S A T | 4.20 | — | 22 |
| 1.2.13 | 429 | L D M M L T C V E | 5.10 | 9 | 23 |
| 1.2.14 | 264 | L R I P S G F I S | 5.00 | 5 | 24 |
| 1.2.15 | 270 | F I S Y I L N R H | 4.48 | —/11 | 25 |
| 1.2.16 | 275 | L N R H D N Q N L | 4.10 | 6 | 26 |
| 1.2.17 | 325 | F N A E F N E I R | 4.30 | — | 27 |
| 1.2.18 | 329 | F N E I R R V L L | 4.60 | — | 28 |
| 1.2.19 | 335 | V L L E E N A G G | 4.20 | — | 29 |

Pos. is the residue position in the primary sequence of the first amino acid in the antigenic epitope. Sequence is the amino acid sequence of the predicted MHC Class II-presented epitope. Score is the score reported by the ProPred program, for the relative likelihood of being presented by many common HLA-DR alleles. Ii-Key is the number of residue positions intervening between an Ii-Key motif and the first residue of the antigenic epitope.

In Table 1.2, PEPTIDES: 1.2.1, 1.2.3, 1.2.6, 1.2.5, and 1.2.18 overlap to some degree with experimentally defined IgE-binding epitopes of Table 1.4. PEPTIDES 1.2.9, 1.2.10, 1.2.11, 1.2.12 are peptides with altered amino acid sequences in a recombinant, mutated Ara h 1 (Burks A W. Eur J Immunol. 1997 245:334-9). IgE epitopes were defined further in the work of Shin et al. (J Biol Chem. 1998 273:13753-9).

TABLE 1.3

Ii-Key/Ara h 1 hybrids containing some of the predicted MHC Class II-presented Ara h 1 epitopes of Table 1.2.

| PEPTIDE | Pos. | Sequence | SEQ ID NO: |
|---|---|---|---|
| 1.3.1 | 192 | Ac-LRMK-ava-IRVLQRFDQ-NH$_2$ | 30 |
| 1.3.2 | 1 | Ac-LRMK-ava-MRGRVSPLM-NH$_2$ | 31 |
| 1.3.3 | 1/8/10/14 | Ac-LRMK-ava-MRGRVSPLML LLGILVLASV SAT-NH$_2$ | 32 |
| 1.3.4 | 205 | Ac-LRMK-ava-FQNLQNHRI-NH$_2$ | 33 |
| 1.3.5 | 205/208 | Ac-LRMK-ava-FQNLQNHRIVQI-NH$_2$ | 34 |
| 1.3.6 | 428 | Ac-LRMK-ava-LDMMLTCVE-NH$_2$ | 35 |
| 1.3.7 | 263 | Ac-LRMK-ava-LRIPSGFIS-NH$_2$ | 36 |
| 1.3.8 | 263/269/274 | Ac-LRMK-ava-LRIPSGFISYILNRHDNQ NL-NH$_2$ | 37 |

Pos. is the residue position in the primary sequence of the first amino acid in the antigenic epitope. Sequence is the amino acid sequence of a hybrid peptide containing a MHC Class II epitope of Table 1.2. Ii-Key is the number of residue positions intervening between an Ii-Key motif and the first residue of the antigenic epitope.

The activity of additional Ii-Key/Ara h antigenic epitope hybrids are tested with one residue of ä-aminovaleric acid as a spacer because, in previous studies of a series of hybrids with systematic variation of spacer structures, the hybrid with one ava residue was no less active than any hybrid with a more complex spacer sequence. In the Ara h hybrids, the Ii-Key-spacer (LRMK-ava) (SEQ ID NO: 9) sequence was linked to the first amino acid of the ProPred-identified peptide, which amino acid is thought to fit into pocket 1 of the antigenic peptide-binding site of the MHC Class II molecules.

The peptides of Table 1.3 are characterized as follows. PEPTIDE 1.3.1 contains the ProPred-predicted MHC Class II-presented epitope PEPTIDE 1.2.2. PEPTIDE 1.3.2 is a composite of the first two MHC Class II-presented epitopes (PEPTIDE 1.2.9; PEPTIDE 1.2.11), overlapping by two amino acids. PEPTIDE 1.3.3 is a composite of the first four MHC Class II-presented epitopes (PEPTIDE 1.2.11, PEPTIDE 1.2.9, PEPTIDE 1.2.10, PEPTIDE 1.2.12). PEPTIDES 1.3.2 and 1.3.3 are peptides with altered amino acid sequences in the recombinant, mutated Ara h 1 (Burks A W.

Eur J Immunol. 1997 245:334-9). PEPTIDE 1.3.4 contains the ProPred-predicted MHC Class II-presented epitopes PEPTIDE 1.2.8. PEPTIDE 1.3.5 is the composite of two MHC Class II-predicted epitopes (PEPTIDE 1.2.7 and PEPTIDE 1.2.8), overlapping by six amino acids. PEPTIDE 1.3.6 contains the ProPred-predicted MHC Class II-presented epitope PEPTIDE 1.2.13. PEPTIDE 1.3.7 contains the ProPred-predicted MHC Class II-presented epitope PEPTIDE 1.2.14. PEPTIDE 1.3.8 is the composite of three MHC Class II-predicted epitopes (PEPTIDE 1.2.14, PEPTIDE 1.2.15 and PEPTIDE 1.2.16), overlapping by three and four amino acids, respectively.

TABLE 1.4

Experimentally defined IgE-binding Ara h 1 epitopes which overlap with predicted MHC Class II-presented Ara h 1 epitopes.

| PEPTIDE | Pos. | Sequence | SEQ ID NO: |
|---|---|---|---|
| 1.4.1 | 409 | NNFGKLFEVK | 38 |
| 1.4.2 | 311 | SYLQEFSRNT | 39 |
| 1.4.3 | 498 | RRYTARLKEG | 40 |
| 1.4.4 | 325 | FNAEFNEIRR | 41 |
| 1.4.5 | 461 | GTGNLELVAV | 42 |

Pos. is the residue position in the primary sequence of the first amino acid in the antigenic epitope. Sequence is the amino acid sequence of the predicted MHC Class II-presented epitope. Ii-Key is the number of residue positions intervening between an Ii-Key motif and the first residue of the antigenic epitope.

The PEPTIDES of Table 1.5 are characterized as follows. PEPTIDES 1.5.1, 1.5.6, and 1.5.10 include residues of an experimentally defined, IgE-binding epitope. PEPTIDES 1.5.1, 1.5.2, 1.5.4, 1.5.6, 1.5.9, and 1.5.10 have residues of a ProPred-predicted MHC Class II-presented epitopes. PEPTIDES 1.5.2, 1.5.3, 1.5.4, 1.5.5, 1.5.6, 1.5.7, 1.5.8 and 1.5.10 share amino acids between overlapping IgE binding and MHC Class II-presented epitopes. PEPTIDES 1.5.4, 1.5.5, 1.5.6, 1.5.8, 1.5.9, and 1.5.10 share amino acids between overlapping MHC Class II-presented epitopes.

The peptides of Table 1.5 are characterized as follows. PEPTIDE 1.5.1 is the composite of MHC Class II-presented epitope with the highest ProPred predictive binding score (PEPTIDE 1.2.1) and IgE binding epitope (PEPTIDE 1.4.1), overlapping by 2 amino acids. PEPTIDE 1.5.2 is the composite of MHC Class II-presented epitope SEQ ID NO 44 and IgE binding epitope PEPTIDE 1.4.2, overlapping by 8 amino acids. PEPTIDE 1.5.3 is the composite of MHC Class II-presented epitope PEPTIDE 1.2.6 and IgE binding epitope PEPTIDE 1.4.3, overlapping by 8 amino acids. PEPTIDE 1.5.4 contains MHC Class II-predicted epitope PEPTIDE 1.2.4 and an IgE binding epitope PEPTIDE 1.4.5, overlapping by 1 amino acid. PEPTIDE 1.5.5 contains MHC Class II-predicted epitope PEPTIDE 1.5 and an IgE binding epitope PEPTIDE 1.4.5, overlapping by 5 amino acids. PEPTIDE 1.5.6 is the composite of the two MHC Class II-predicted epitopes, PEPTIDE 1.2.4 and PEPTIDE 1.2.5, overlapping by 5 amino acids. Additionally, there is a 5 amino acids overlap with IgE binding epitope (PEPTIDE 1.4.5). PEPTIDE 1.5.7 contains MHC Class II-predicted epitope PEPTIDE 1.2.17 and an IgE binding epitope PEPTIDE 1.4.4, overlapping by 9 amino acids. PEPTIDE 1.5.8 contains MHC Class II-predicted epitope PEPTIDE 1.18 and an IgE binding epitope PEPTIDE 1.4.4, overlapping by 6 amino acids. PEP-

TABLE 1.5

Ii-Key/Ara h 1 hybrids containing predicted MHC Class II Ara h 1 epitopes and experimentally determined IgE-binding Ara h 1 epitopes.

| PEPTIDE | Pos. | Sequence | SEQ ID NO: |
|---|---|---|---|
| 1.5.1 | 416 | Ac-LRMK-ava-NNFGKLFEVKPDKKNPQ-NH$_2$ | 43 |
| 1.5.2 | 312 | Ac-LRMK-ava-LQGFSRNTL-NH$_2$ | 44 |
| 1.5.3 | 496 | Ac-LRMK-ava-VRRYTARLK-NH$_2$ | 45 |
| 1.5.4 | 452 | Ac-LRMK-ava-MVIVVVNKG-NH$_2$ | 46 |
| 1.5.5 | 456 | Ac-LRMK-ava-VVNKGTGNL-NH$_2$ | 47 |
| 1.5.6 | 452 | Ac-LRMK-ava-MVIVVVNKGTGNLELVAV-NH$_2$ | 48 |
| 1.5.7 | 324 | Ac-LRMK-ava-FNAEFNEIR-NH$_2$ | 49 |
| 1.5.8 | 328 | Ac-LRMK-ava-FNEIRRVLL-NH$_2$ | 50 |
| 1.5.9 | 334 | Ac-LRMK-ava-VLLEENAGG-NH$_2$ | 51 |
| 1.5.10 | 324/328/334 | Ac-LRMK-ava-FNAEFNEIRRVLLEENAGG-NH$_2$ | 52 |

Pos. is the residue position in the primary sequence of the first amino acid in the antigenic epitope. Sequence is the amino acid sequence of the proposed hybrid containing a predicted MHC Class II-presented epitope of Table 1.2 and an IgE binding epitope of Table 1.4. Ii-Key is the number of residue TIDE 1.5.9 contains MHC Class II-predicted epitope PEPTIDE 1.2.19. PEPTIDE 1.5.10 is the composite of the three MHC Class II-predicted epitopes PEPTIDES 1.2.17, 1.2.18, and 1.2.19 and IgE binding epitope PEPTIDE 3.1.5. PEPTIDE 1.5.5 is the composite of three MHC Class II-predicted epitopes (PEPTIDES 1.2.17, 1.2.18 and 1.2.19), overlapping by 5 and 3 amino acids, respectively. Additionally, there is a 9 amino acid overlap with IgE binding epitope (PEPTIDE 1.4.4).

Example 2

Ii-Key/Ara h 2 Peanut Antigenic Epitope Hybrids

In another aspect, this invention relates to the design of Ii-Key/Ara h 2 antigenic epitope hybrids. Sampson, WO 0052154, a series of Ara h 2 MHC Class II-presented epitopes, which had been experimentally identified by Burks A W. (J Allergy Clin Immunol. 1992 90:962-7). Ara h 2-specific T cell lines were established from the peripheral blood of 12 atopic and 4 nonatopic individuals. All of the T cell lines were predominantly CD 4+ T cells. Reactivity of each of these T cell lines was tested against individual peptides from a library of overlapping Ara h 2 peptides. Four immunodominant T cell epitopes were identified for Ara h 2: epitope 1 (amino acids 18-28), epitope 2 (amino acids 45-55), epitope 3 (amino acids 95-108), and epitope 4 (amino acids 134-144). Epitopes 1, 2, and 4 have overlapping sequences with IgE antibody-recognized epitopes while epitope 3 does not overlap IgE binding epitopes. Bannon and colleagues suggested that such sequences provide for the possibility for the development of a non-anaphylactic, T cell-directed immunotherapeutic (Bannon G A. Int Arch Allergy Immunol. 2001 124: 70-72). The sequence of Ara h 2 in Table 2.1 was taken from GenBank gi/15418705/allergen II [*Arachis hypogaea*]. Experimentally defined MHC Class II-presented Ara h 2 epitopes are listed in Table 2.2. Ii-Key/Ara h 2 hybrids containing some of the experimentally defined MHC Class II-presented Ara h 2 epitopes of Table 2.2 are listed in Table 2.3. Predicted MHC Class II epitopes of Ara h 2 are listed in Table 2.4. Ii-Key/Ara h 2 hybrids containing some of the predicted MHC Class II-presented Ara h 2 epitopes of Table 2.4 are listed in Table 2.5. Experimentally defined IgE-binding Ara h 2 epitopes, which overlap with predicted MHC Class II-presented Ara h 2 epitopes from Table 2.4 are listed in Table 2.6. Hybrids containing predicted MHC Class II Ara h 2 epitopes and overlapping experimentally determined IgE-binding Ara h 2 epitopes are listed in Table 2.7.

TABLE 2.1

Deduced amino acid sequence of Ara h 2.
(SEQ ID NO: 53)

```
  1 makltilval alfllaahas arqqwelqgd rrcqsqlera
    nlrpceqhlm
 51 qkiqrdedsy erdpyspsqd pyspspydrr gagssqhqer
    ccnelnefen
101 nqrcmcealq qimenqsdrl qgrqqeqqfk relrnlpqqc
    glrapqrcdl
151 dvesgg
```

TABLE 2.2

Experimentally defined MHC Class II-
presented Ara h 2 epitopes.

| PEPTIDE | Pos. | Sequence | Ii-Key | SEQ ID NO: |
|---|---|---|---|---|
| 2.2.1 | 22 | RQQWE LQGDRRCQSQ | 3 | 54 |
| 2.2.2 | 42 | LRPCEQHLMQKIQRDEDSYE | – | 55 |
| 2.2.3 | 7 | HQERCCNELN | – | 56 |
| 2.2.4 | 102 | QRCMCEALQQ | – | 57 |
| 2.2.5 | 137 | PQQCGLRAPQ | – | 58 |

Pos. is the residue position in the primary sequence of the first amino acid in the antigenic epitope. Sequence is the amino acid sequence of an experimentally determined MHC Class II-presented epitope. Ii-Key is the number of residue positions intervening between an Ii-Key motif and the first residue of the antigenic epitope.

The PEPTIDES of Table 2.2 are characterized as follows. PEPTIDES 2.2.1, 2.2.2, 2.2.4, and 2.2.5 are ProPred-predicted MHC Class II-presented sequences. PEPTIDE 2.2.1 contains an IgE binding epitopes. PEPTIDES 2.2.1 and 2.2.2 have overlapping amino acids of the IgE binding epitope and MHC Class II-presented epitope. Pos. is the residue number in the primary amino acid sequence of the first amino acid of the epitope. Many of the experimentally predicted epitopes are also predicted with the ProPred algorithm, either entirely or partially.

TABLE 2.3

Ii-Key/Ara h 2 hybrids containing some of the
experimentally defined MHC Class
II-presented Ara h 2 epitopes of Table 2.2.

| PEPTIDE | Pos. | Sequence | SEQ ID NO: |
|---|---|---|---|
| 2.3.1 | 19 | Ac-LRMK-ava-RQQWE LQGDRRCQSQ-NH$_2$ | 59 |
| 2.3.2 | 39 | Ac-LRMK-ava-LRPCEQHLMQKIQRDEDSYE-NH$_2$ | 60 |
| 2.3.3 | 84 | Ac-LRMK-ava-HQERCCNELN-NH$_2$ | 61 |
| 2.3.4 | 99 | Ac-LRMK-ava-QRCMCEALQQ-NH$_2$ | 62 |
| 2.3.5 | 135 | Ac-LRMK-ava-PQQCGLRAPQ-NH$_2$ | 63 |

Pos. is the residue position in the primary sequence of the first amino acid in the antigenic epitope. Sequence is the amino acid sequence of a hybrid peptide containing a MHC Class II epitope of Table 2.2. Score is the score reported by the Pro-Pred program, for the relative likelihood of being presented by many common HLA-DR alleles. Ii-Key is the number of residue positions intervening between an Ii-Key motif and the first residue of the antigenic epitope.

The PEPTIDES of Table 2.3 are characterized as follows. PEPTIDE 2.3.1 contains an experimentally defined, IgE-binding epitope. PEPTIDES 2.3.1 and 2.3.2 share amino acids between overlapping IgE binding and MHC Class II-presented epitopes. PEPTIDES 2.3.2 and 2.3.3 are peptides with altered amino acid sequences in the modified Ara h 1 of Burks and colleagues (Burks A W. Eur J Immunol. 1997 245:334-9). Pos. is the residue number in the primary amino acid sequence of the first amino acid of the epitope.

TABLE 2.4

Predicted MHC Class II epitopes of Ara h 2.

| PEPTIDE | Pos. | Sequence | Score | Ii-key | SEQ ID NO: |
|---|---|---|---|---|---|
| 2.4.1 | 5 | I L V A L A L F L | 6.10 | — | 64 |
| 2.4.2 | 26 | L Q G D R R C Q S | 5.80 | 8 | 65 |
| 2.4.3 | 3 | L T I L V A L A L | 5.30 | — | 66 |
| 2.4.4 | 49 | L M Q K I Q R D E | 4.10 | — | 67 |
| 2.4.5 | 12 | L F L L A A H A S | 3.30 | 4 | 68 |
| 2.4.6 | 7 | L V A L A L F L L | 4.70 | — | 69 |
| 2.4.7 | 42 | L R P C E Q H L M | 3.60 | — | 70 |
| 2.4.8 | 10 | L A L F L L A A H | 3.30 | 2 | 71 |
| 2.4.9 | 133 | L R N L P Q Q C G | 2.70 | — | 72 |
| 2.4.10 | 37 | L E R A N L R P C | 2.20 | — | 73 |
| 2.4.11 | 13 | F L L A A H A S A | 1.90 | 5 | 74 |
| 2.4.12 | 77 | Y D R R G A G S S | 1.90 | — | 75 |
| 2.4.13 | 98 | F E N N Q R C M C | 1.70 | — | 76 |

Pos. is the residue position in the primary sequence of the first amino acid in the antigenic epitope. Sequence is the amino acid sequence of the predicted MHC Class II-presented epitope. Score is the score reported by the ProPred program, for the relative likelihood of being presented by many common HLA-DR alleles. Ii-Key is the number of residue positions intervening between an Ii-Key motif and the first residue of the antigenic epitope.

The PEPTIDES of Table 2.4 are characterized as follows. PEPTIDES 2.4.1, 2.4.5, 2.4.6, 2.4.8, and 2.4.11 are peptides not preserved in an Ara h 2 modified to decrease allergic IgE binding. In PEPTIDE 2.4.4 R54 is replaced by A. In PEPTIDE 2.4.7 P43 and Q46 are each replaced by A. PEPTIDES 2.4.2, 2.4.4, 2.4.9, 2.4.10, and 2.4.13 are experimentally defined T cell epitopes. PEPTIDES 2.4.2, 2.4.4, 2.4.7, 2.4.10, and 2.4.11 have amino acids of an IgE binding epitope.

TABLE 2.5

Ii-Key/Ara h 2 hybrids containing some of the predicted MHC Class II-presented Ara h 2 epitopes of Table 2.4.

| PEPTIDE | Pos. | Sequence | SEQ ID NO: |
|---|---|---|---|
| 2.5.1 | 5 | Ac-LRMK-ava-ILVALALFL-NH$_2$ | 77 |
| 2.5.2 | 3 | Ac-LRMK-ava-LTILVALAL-NH$_2$ | 78 |
| 2.5.3 | 6 | Ac-LRMK-ava-LVALALFLL-NH$_2$ | 79 |
| 2.5.4 | 3/5/6 | Ac-LRMK-ava-LTILVALALFLL-NH$_2$ | 80 |
| 2.5.5 | 132 | Ac-LRMK-ava-LRNLPQQCG-NH$_2$ | 81 |
| 2.5.6 | 76 | Ac-LRMK-ava-YDRRGAGSS-NH$_2$ | 82 |
| 2.5.7 | 97 | Ac-LRMK-ava-FENNQRCMC-NH$_2$ | 83 |

Pos. is the residue position in the primary sequence of the first amino acid in the antigenic epitope. Sequence is the amino acid sequence of a hybrid peptide containing a MHC Class II epitope of Table 2.4. Ii-Key is the number of residue positions intervening between an Ii-Key motif and the first residue of the antigenic epitope.

The PEPTIDES of Table 2.5 are characterized as follows. PEPTIDES 2.5.1, 2.5.2, 2.5.3, 2.5.4 are peptides not preserved in the modified Ara h 2. PEPTIDES 2.5.5 and 2.5.7 are experimentally defined CD4+ T cell epitopes.

In another aspect, this invention provides for the immunodeviation of an allergic patient's antibody response from an IgE pattern to an IgG or IgG subtype pattern. The decrease synthesis of IgE antibodies to the allergen and/or the synthesis of IgG antibodies, which block the binding of IgE antibodies, has a desired therapeutic effect. To this end MHC Class II epitopes of the allergen are joined with an IgE binding peptide sequence in an Ii-Key/MHC Class II epitope/IgE epitope hybrid peptide. The sequences so combined may be taken from different segments of the primary amino acid sequence of the allergen. For example, a MHC Class II epitope with a high ProPred score can be coupled to a peptide from an IgE-recognized site on the allergen. Preferably, however, those two respective MHC Class II-presented and IgE-recognized sites overlap in the primary sequence of the allergen. Such hybrids combining MHC Class II-presented Ara h2 2 epitopes from Table 2.4 and experimentally determined IgE binding epitopes of Table 2.6 are presented in Table 2.7.

TABLE 2.6

Experimentally defined IgE-binding Ara h 2 epitopes, which overlap with predicted MHC Class II-presented Ara h 2 epitopes from Table 2.4.

| PEPTIDE | Pos. | SEQUENCE | Ii-Key | SEQ ID NO: |
|---|---|---|---|---|
| 2.6.1 | 18 | HASARQQWEL | 10 | 84 |
| 2.6.2 | 24 | QWELQGDRRC | 5 | 85 |
| 2.6.3 | 30 | DRRCQSQLER | 11 | 86 |
| 2.6.4 | 42 | LRPCEQHLMO | — | 87 |
| 2.6.5 | 52 | KIQRDEDSYE | — | 88 |
| 2.6.6 | 130 | KRELRNLPQQ | — | 89 |

Pos. is the residue position in the primary sequence of the first amino acid in the antigenic epitope. Sequence is the amino acid sequence of an experimentally determined IgE binding epitope. Ii-Key is the number of residue positions intervening between an Ii-Key motif and the first residue of the antigenic epitope.

TABLE 2.7

Hybrids containing predicted MHC Class II Ara h 2 epitopes and overlapping experimentally determined IgE-binding Ara h 2 epitopes.

| PEPTIDE | Pos. | Sequence | SEQ ID NO: |
|---|---|---|---|
| 2.7.1 | 26 | Ac-LRMK-ava-LQGDRRCQS-NH$_2$ | 90 |
| 2.7.2 | 48 | Ac-LRMK-ava-LMQKIQRDE-NH$_2$ | 91 |
| 2.7.3 | 41 | Ac-LRMK-ava-LRPCEQHLM-NH$_2$ | 92 |
| 2.7.4 | 41/48 | Ac-LRMK-ava-LRPCEQHLMQKIQRDE-NH$_2$ | 93 |
| 2.7.5 | 36 | Ac-LRMK-ava-LERANLRPCEQHLMO-NH$_2$ | 94 |
| 2.7.6 | 12 | Ac-LRMK-ava-FLLAAHASARQQWEL-NH$_2$ | 95 |

Pos. is the residue position in the primary sequence of the first amino acid in the antigenic epitope. Sequence is the amino acid sequence of a hybrid peptide containing a MHC Class II epitope of Table 2.4 and an IgE binding epitope of Table 2.6. Ii-Key is the number of residue positions intervening between an Ii-Key motif and the first residue of the antigenic epitope.

The PEPTIDES of Table 2.7 are characterized as follows. PEPTIDE 2.7.1 contains predicted and experimentally defined MHC Class II epitope PEPTIDE 7.2, which coincides with IgE binding epitope PEPTIDES 2.6.2 and 2.6.3. PEPTIDE 2.7.2 contains predicted and experimentally defined MHC Class II epitope PEPTIDE 7.4, which coincides with IgE binding epitope PEPTIDES 2.6.4 and 2.6.5. PEPTIDE 2.7.3 contains predicted MHC Class II epitope PEPTIDE 7.7, which coincides with IgE binding epitope PEPTIDE 2.6.4. PEPTIDE 2.7.4 contains MHC Class II epitopes PEPTIDE 7.4 and 7.7, and IgE binding epitopes PEPTIDE 2.6.4 and 2.6.5. PEPTIDE 2.7.5 contains MHC Class II epitope PEPTIDE 7.10 overlapping with IgE binding epitope PEPTIDE 2.6.4. PEPTIDE 2.7.6 contains MHC Class II epitope PEPTIDE 7.11, overlapping with IgE binding epitope PEPTIDE 2.6.1.

Example 3

Ii-Key/Ara h 3 Peanut Antigenic Epitope Hybrids

In another aspect, this invention relates to the design of Ii-Key/Ara h 3 antigenic epitope hybrids. Rabjohn et al. reported the molecular cloning and T cell epitope analysis of the peanut allergen Ara h3 (J Clin Invest. 1999 103:535-42). The sequence of Ara h 3 in Table 3.1 was taken from GenBank gi/3703107/glycin. Predicted MHC Class II epitopes of Ara h 3 are listed in Table 3.2. Ii-Key/Ara h 3 hybrids containing some of the MHC Class II-presented epitopes of Table 3.2 are listed in Table 3.3. Experimentally defined IgE-binding Ara h 3 epitope, overlapping with a predicted MHC Class II-presented Ara h 3 epitope are listed in Table 3.4. Hybrids containing predicted MHC Class II Ara h 3 epitopes overlapping experimentally defined IgE-binding epitopes Table 3.5.

TABLE 3.1

Deduced amino acid sequence of Ara h 3.
(SEQ ID NO: 96)

```
  1 rqqpeenacq fqrlnaqrpd nrieseggyi etwnpnnqef ecagvalsrl 51 vlrrnalrrp fysnapqeif iqqgrgyfgl ifpgcprhye ephtqgrrsq 101 sqrpprrlqg edqsqqqrds hqkvhrfdeg dliavptgva fwlyndhdtd 151 vvavsltdtn nndnqldqfp rrfnlagnte qeflryqqqs rqsrrrslpy 201 spyspqsqpr qeerefsprg qhsrreragq eeeneggnif sgftpefleq 251 afqvddrqiv qnlrgetese eegaivtvrg glrilspdrk rradeeeeyd 301 edeyeydeed rrrgrgsrgr gngieetict asakknigrn rspdiynpqa 351 gslktandln llilrwlgps aeygnlyrna lfvahyntna hsiiyrlrgr 401 ahvqvvdsng nrvydeelqe ghvlvvpqnf avagksqsen feyvafktds 451 rpsianlage nsvidnlpee vvansyglqr eqarqlknnn pfkffvppsq 501 qsprava
```

TABLE 3.2

Predicted MHC Class II epitopes of Ara h 3.

| PEPTIDE | Pos. | Sequence | Score | Ii-Key | SEQ ID NO: |
|---|---|---|---|---|---|
| 3.2.1 | 395 | Y R L R G R A H V | 6.10 | — | 97 |
| 3.2.2 | 393 | I I Y R L R G R A | 4.70 | 6 | 98 |
| 3.2.3 | 446 | F K T D S R P S I | 5.70 | — | 99 |
| 3.2.4 | 278 | V R G G L R I L S | 5.40 | — | 100 |
| 3.2.5 | 274 | I V T V R G G L R | 5.00 | 10 | 101 |
| 3.2.6 | 282 | L R I L S P D R K | 4.70 | — | 102 |
| 3.2.7 | 252 | F Q V D D R Q I V | 5.20 | — | 103 |
| 3.2.8 | 364 | L R W L G P S A E | 5.00 | — | 104 |
| 3.2.9 | 362 | L I L R W L G P S | 4.80 | — | 105 |
| 3.2.10 | 173 | F N L A G N T E Q | 4.80 | — | 106 |
| 3.2.11 | 424 | L V V P Q N F A V | 4.70 | — | 107 |
| 3.2.12 | 403 | V Q V V D S N G N | 4.50 | 4 | 108 |
| 3.2.13 | 405 | V V D S N G N R V | 4.10 | 6 | 109 |
| 3.2.14 | 382 | F V A H Y N T N A | 4.40 | — | 110 |

Pos. is the residue position in the primary sequence of the first amino acid in the antigenic epitope. Sequence is the amino acid sequence of the predicted MHC Class II-presented epitope. Score is the score reported by the ProPred program, for the relative likelihood of being presented by many common HLA-DR alleles. Ii-Key is the number of residue positions intervening between an Ii-Key motif and the first residue of the antigenic epitope.

TABLE 3.3

Ii-Key/Ara h 3 hybrids containing some of the MHC Class II-presented epitopes of Table 3.2.

| PEPTIDE | Pos. | Sequence | SEQ ID NO: |
|---|---|---|---|
| 3.3.1 | 393 | Ac-LRMK-ava-IIYRLRGRA-NH$_2$ | 111 |
| 3.3.2 | 395 | Ac-LRMK-ava-YRLRGRAHV-NH$_2$ | 112 |
| 3.3.3 | 393/395 | Ac-LRMK-ava-IIYRLRGRAHV-NH$_2$ | 113 |
| 3.3.4 | 446 | Ac-LRMK-ava-FKTDSRPSI-NH$_2$ | 114 |
| 3.3.5 | 362 | Ac-LRMK-ava-LILRWLGPS-NH$_2$ | 115 |
| 3.3.6 | 364 | Ac-LRMK-ava-LRWLGPSAE-NH$_2$ | 116 |
| 3.3.7 | 362/364 | Ac-LRMK-ava-LILRWLGPSAE-NH$_2$ | 117 |
| 3.3.8 | 252 | Ac-LRMK-ava-FQVDDRQIV-NH$_2$ | 118 |
| 3.3.9 | 173 | Ac-LRMK-ava-FNLAGNTEQ-NH$_2$ | 119 |
| 3.3.10 | 424 | Ac-LRMK-ava-LVVPQNFAV-NH$_2$ | 120 |
| 3.3.11 | 403 | Ac-LRMK-ava-VQVVDSNGN-NH$_2$ | 121 |
| 3.3.12 | 405 | Ac-LRMK-ava-VVDSNGNRV-NH$_2$ | 122 |
| 3.3.13 | 403/405 | Ac-LRMK-ava-VQVVDSNGNRV-NH$_2$ | 123 |
| 3.3.14 | 382 | Ac-LRMK-ava-FVAHYNTNA-NH$_2$ | 124 |

Pos. is the residue position in the primary sequence of the first amino acid in the antigenic epitope. Sequence is the amino acid sequence of a hybrid peptide containing a MHC Class II epitope of Table 3.2.

PEPTIDE 3.3.1 contains the ProPred-predicted MHC Class II-presented epitope PEPTIDE 3.2.2. PEPTIDE 3.3.2 contains the ProPred-predicted MHC Class II-presented epitope PEPTIDE 3.2.1. PEPTIDE 3.3.3 is a composite of two ProPred-predicted MHC Class II-presented epitopes (PEPTIDES 3.2.1 and 3.2.2), overlapping by 7 amino acids. PEPTIDE 3.3.4 contains the ProPred-predicted MHC Class II-presented epitope PEPTIDE 3.2.3. PEPTIDE 3.3.5 contains the ProPred-predicted MHC Class II-presented epitope PEPTIDE 3.3.6. PEPTIDE 3.2.6 contains the ProPred-predicted MHC Class II-presented epitope PEPTIDE 3.2.8. PEPTIDE 3.3.7 is a composite of two ProPred-predicted MHC Class II-presented epitopes (PEPTIDES 3.2.9 and 3.2.8), overlapping by 7 amino acids. PEPTIDE 3.3.8 contains the ProPred-predicted MHC Class II-presented epitope PEPTIDE 3.2.7. PEPTIDE 3.3.9 contains the ProPred-predicted MHC Class II-presented epitope PEPTIDE 3.2.10. PEPTIDE 3.3.10 contains the ProPred-predicted MHC Class II-presented epitope PEPTIDE 3.2.11. PEPTIDE 3.3.11 contains the ProPred-predicted MHC Class II-presented epitope PEPTIDE 3.2.11. PEPTIDE 3.3.12 contains the ProPred-predicted MHC Class II-presented epitope PEPTIDE 3.2.13. PEPTIDE 3.3.13 is a composite of two ProPred-predicted MHC Class II-presented epitopes (PEPTIDES 3.2.12 and 3.2.13), overlapping by 7 amino acids. PEPTIDE 3.3.14 contains the ProPred-predicted MHC Class II-presented epitope PEPTIDE 3.2.14.

TABLE 3.4

Experimentally defined IgE-binding Ara h 3 epitope, overlapping with a predicted MHC Class II-presented Ara h 3 epitope.

| PEPTIDE | Pos. | Sequence | Ii-Key | SEQ ID NO: |
|---|---|---|---|---|
| 3.4.1 | 276 | VTVRGGLRILSPDRK | 11 | 125 |

Pos. is the residue position in the primary sequence of the first amino acid in the antigenic epitope. Ii-Key is the number of residue positions intervening between an Ii-Key motif and the first residue of the antigenic epitope.

TABLE 3.5

Hybrids containing predicted MHC Class II Ara h 3 epitopes overlapping experimentally defined IgE-binding epitopes.

| PEPTIDE | POS. | Sequence | SEQ ID NO: |
|---|---|---|---|
| 3.5.1 | 274 | Ac-LRMK-ava-IVTVRGGLR-$NH_2$ | 126 |
| 3.5.2 | 277 | Ac-LRMK-ava-VRGGLRILS-$NH_2$ | 127 |
| 3.5.3 | 281 | Ac-LRMK-ava-IVTVRGGLRILSPDRK-$NH_2$ | 128 |
| 3.5.4 | 274/277/281 | Ac-LRMK-ava-IVTVRGGLRILSPDRK-$NH_2$ | 129 |

Pos. is the residue position in the primary sequence of the first amino acid in the antigenic epitope. Sequence is the amino acid sequence of a hybrid peptide containing a MHC Class II epitope of Table 3.2 and an IgE binding epitope of Table 3.4.

The PEPTIDES of Table 3.5 are characterized as follows. PEPTIDES 3.5.1-3.5.4 share amino acids between IgE binding and MHC Class II-presented epitopes. PEPTIDE 3.5.1 contains the predicted MHC Class II epitope PEPTIDE 3.2.5, which coincides with experimentally defined IgE binding epitope PEPTIDE 13.1. PEPTIDE 3.5.2 contains the predicted MHC Class II epitope PEPTIDE 3.5.4, which coincides with experimentally defined IgE binding epitope PEPTIDE 3.4.1. PEPTIDE 3.4.3 contains the predicted MHC Class II epitope PEPTIDE 3.2.6, which coincides with experimentally defined IgE binding epitope PEPTIDE 3.4.1. PEPTIDE 3.4.4 is a composite of three ProPred-predicted MHC Class II-presented epitopes (PEPTIDE 3.2.4, 3.2.5 and 3.2.6), which coincide with IgE binding epitope PEPTIDE 3.4.1.

Example 4

Ii-Key/Fel d 1 Cat Dander Antigenic Epitope Hybrids

In another aspect, this invention relates to the design of Ii-Key/Fel d 1 antigenic epitope hybrids. Such Ii-Key/Fel d 1 antigenic epitope hybrids comprise the Ii-Key motif LRMK (SEQ ID NO: 3) and modifications, joined through a functionally acceptable linker to a MHC Class II-presented epitopes of the Fel d 1 major allergen protein of cat dander. The amino acid sequences of Fel d 1 chains 1 and 2 in Table 4.1 were taken from GenBank gi/1082945/chain 1 and gi/1082946/chain 2 (Morgenstern J P. Proc Natl Acad Sci USA. 1991 88:9640-4). The MHC Class II-presented epitopes of Fel d 1 (chain 1) listed in Table 4.2 include those with the highest scores in the ProPred program analysis. Table 4.3 presents Ii-Key/Fel d 1 (chain 1) hybrids containing some of the predicted MHC Class II-presented epitopes of Table 2. Table 4.4 presents Fel d 1 (chain 1) MHC Class II-presented peptides which elicit allergic responses in cat dander-atopic humans (Haselden B M. J Exp Med. 1999 189: 1885-94). Table 4.5 presents Ii-Key/Fel d 1 (chain 1) hybrids containing some of the experimentally defined MHC Class II-presented epitopes of Table 4.4. Table 4.6 presents predicted MHC Class II-presented epitopes of Fel d 1 (chain 2). Table 4.7 presents designed Ii-Key/Fel d 1 (chain 2) hybrids containing some of the MHC Class II-presented epitopes of Table 4.6. Table 4.8 presents Fel d 1 (chain 2) MHC Class II-presented peptides which elicit allergic responses in cat dander-atopic humans (Haselden B M. J Exp Med. 1999 189: 1885-94). Table 4.9. presents designed Ii-Key/Fel d 1 (chain 2) hybrids containing some of the MHC Class II-presented epitopes of Table 4.8. Since some of the epitope peptides alone can induce hyporesponsiveness to cat dander allergen challenge in the clinic (Oldfield W L. J Immunol. 2001 167:1734-9; Mazzarella G. Allergy 2000 61:6-9), the corresponding hybrids will be more potent and less susceptible to induce anaphylaxis during clinical testing or therapy. Methods for such analyses and therapy are presented in Larche M. WO99/34826 and U.S. Pat. No. 6,120,769 (2000), which are incorporated herein by reference.

Asthma is a complex inflammatory disease of the lung characterized by variable airflow obstruction, bronchial hyper-responsiveness, and airway inflammation. Inflammation in asthma consists of airway infiltration by mast cells, lymphocytes, and eosinophils. There is accumulating evidence that CD4+ cells with a Th2-cytokine pattern play a pivotal role in the pathogenesis of asthma. These cells orchestrate the recruitment and activation of the primary effector cells of the allergic response (mast cells and eosinophils), through the release of cytokines such as IL-4, IL-5, and IL-13. Allergic inflammation is also implicated in airway epithelium changes, although the mechanisms by which inflammatory cells and, in particular, T cells interact with the epithelium are not completely clarified.

Treatment of mice in an ovalbumin-induced asthmatic response with superagonistic Th1-skewing peptide 336E-A (ISQAVHAAHAEINAAGR) (SEQ ID NO: 130) resulted in a Th1-like cytokine profile and a significant decrease in airway eosinophilia and OVA-specific IL-4 and IL-5 production (Janssen E. J Immunol. 2000 164:1580-8; Janssen E M. J Immunol. 2000 165:7207-14). In these studies the wild type sequence (ISQAVHAAHAEINEAGR) (SEQ ID NO: 131) was modified in homologs each with a single alanine substitutions at all non-alanine residue positions.

In extension of the principles of this study Pene et al. examined the effects of immunotherapy with Fel d 1 peptides on the response to bronchial provocation tests with a standardized Fel d 1 cat extract on Fel d 1-specific serum IgE and IgG levels and in vitro IL-4 and IFN-ã production (Pene J. J Allergy Clin Immunol. 1998; 102:571-8). Patients allergic to cats received 6 weekly injections of low dose, medium dose, or high dose of Fel d 1 peptides or a placebo. Six weeks after ending immunotherapy, posttreatment $PD_{20}$Forced Expiratory Volume/$_{1\ sec}$ was not significantly different between the treated and placebo groups. However, in the medium- and high-dose groups there was a significant improvement between baseline and posttreatment days. IL-4 release was significantly reduced in the high dose-treated group whereas it was unchanged in the low or medium dose- and in the placebo-treated groups. In all groups, IFN-γ, IgE, and IgG levels remained unchanged. The investigators concluded there was no correlation between the improvement of $PD_{20}FEV_1$ and the decrease in IL-4 production. They suggested that peptide immunotherapy might act by shifting the Fel d 1-induced response of peripheral blood mononuclear cells in vitro from the $T_{h2}$-like to the $T_{h0}$-like phenotype. The Ii-Key/antigenic epitope hybrids presented below include some of the experimentally tested MHC Class II epitopes of these investigators and can be predicted to be of greater potency and have a wider margin of safety in diagnostic and therapeutic applications, for reasons presented previously.

The preceding studies followed the preparation of ALLERVAX CAT, a peptide vaccine containing two peptides of 27 amino acids containing regions of multiple MHC Class II-presented epitopes from the *Felis domesticus* cat allergen Fel dl chain I were produced FC1P1, LFLTGTPDEYVEQVAQY (SEQ ID NO: 132); FC1P2, EQVAQYKALPWLENA (SEQ ID NO: 133); and FC1P3, KALP-VVLENARILKNCV (SEQ ID NO: 134).

The deduced amino acid sequence of Fel d 1 Chain 1 and Chain 2 are presented in Table 4.1 (>gi|1082945|pir||B56413 major allergen Fel dl chain 1 short form -cat; >gi|1082946|pir||C56413 major allergen Fel dl chain 2 precursor -cat). Predicted MHC Class-II-presented epitopes of Fel d 1 (chain 1) are listed in Table 4.3. Designed Ii-Key/Fel d 1 (chain 1) hybrids containing some of the predicted MHC Class II-presented epitopes of Table 4.2 are listed in Table 4.3. Experimentally defined Fel d 1 chain 1 MHC Class II-presented epitopes are listed in Table 4.4. Designed Ii-Key/Fel d 1 (chain 1) hybrids containing some of the MHC Class II-presented epitopes of Table 4.4 are listed I Table 4.5. Predicted MHC Class II-presented epitopes of Fel d 1 (chain 2) are listed in Table 4.6. Designed Ii-Key/Fel d (chain 2) hybrids containing some of the MHC Class II-presented epitopes of Table 4.6 are listed in Table 4.7. Experimentally determined/Fel d 1 (chain 2) MHC Class II-presented epitopes are listed in Table 4.8. Designed Ii-Key/Fel d 1 (chain 2) hybrids containing some of the MHC Class II-presented epitopes of Table 4.8 are listed in Table 4.9.

TABLE 4.1

Deduced amino acid sequence of Fel d 1.

Chain 1.

>gi|1082945|pir||B56413 major allergen Fel dl chain 1 short form - cat (SEQ ID NO: 135)

```
  1  mldaalppcp tvaatadcei cpavkrdvdl fltgtpdeyv eqvaqykalp
 51  vvlenarilk ncvdakmtee dkenalslld kiytsplc
```

Chain 2.

>gi|1082946|pir||C56413 major allergen Fel dl chain 2 precursor - cat (SEQ ID NO: 136)

```
  1  mrgallvlal lvtqalgvkm aetcpifydv ffavangnel lldlsltkvn
 51  atepertamk kiqdcyveng lisrvldglv mttissskdc mgeavqntve
101  dlklntlgr
```

TABLE 4.2

Predicted MHC ClassII-presented epitopes of Fel d 1 (chain 1).

| PEPTIDE | Pos. | Sequence | Score | Ii-Key | SEQ ID NO: |
|---|---|---|---|---|---|
| 4.2.1 | 46 | Y K A L P V V L E | 4.20 | — | 137 |
| 4.2.2 | 51 | V V L E N A R I L | 4.80 | — | 138 |
| 4.2.3 | 43 | V A Q Y K A L P V | 4.70 | — | 139 |
| 4.2.4 | 39 | Y V E Q V A Q Y K | 3.60 | 8 | 140 |
| 4.2.5 | 24 | V K R D V D L F L | 3.4 | — | 141 |
| 4.2.6 | 20 | I C P A V K R D V | 3.1 | — | 142 |
| 4.2.7 | 76 | L S L L D K I Y T | 2.70 | 8 | 143 |
| 4.2.8 | 79 | L D K I Y T S P L | 2.52 | 11 | 144 |
| 4.2.9 | 30 | L F L T G T P D E | 2.40 | — | 145 |

Pos. is the residue position in the primary sequence of the first amino acid in the antigenic epitope. Sequence is the amino acid sequence of the predicted MHC Class II-presented epitope. Score is the score reported by the ProPred program, for the relative likelihood of being presented by many common HLA-DR alleles. Ii-Key is the number of residue positions intervening between an Ii-Key motif and the first residue of the antigenic epitope.

TABLE 4.3

Designed Ii-Key/Fel d 1 (chain 1) hybrids containing some of the predicted MHC Class II-presented epitopes of Table 4.2.

| PEPTIDE | Pos. | Sequence | SEQ ID NO: |
|---|---|---|---|
| 4.3.1 | 43 | Ac-LRMK-ava-VAQYKALPV-NH$_2$ | 146 |
| 4.3.2 | 46 | Ac-LRMK-ava-YKALPVVLE-NH$_2$ | 147 |
| 4.3.3 | 51 | Ac-LRMK-ava-VVLENARIL-NH$_2$ | 148 |
| 4.3.4 | 39 | Ac-LRMK-ava-YVEQVAQYK-NH$_2$ | 149 |
| 4.3.5 | 39/43/46/51 | Ac-LRMK-ava-YVEQVAQYKALPVVLENARIL-NH$_2$ | 150 |
| 4.3.6 | 20 | Ac-LRMK-ava-ICPAVKRDV-NH$_2$ | 151 |
| 4.3.7 | 24 | Ac-LRMK-ava-VKRDVDLFL-NH$_2$ | 152 |
| 4.3.8 | 30 | Ac-LRMK-ava-LFLTGTPDE-NH$_2$ | 153 |
| 4.3.9 | 20/24/30 | Ac-LRMK-ava-ICPAVKRDVDLFLTGTPDE-NH$_2$ | 154 |
| 4.3.10 | 76 | Ac-LRMK-ava-LSLLDKIYT-NH$_2$ | 155 |
| 4.3.11 | 79 | Ac-LRMK-ava-LDKIYTSPL-NH$_2$ | 156 |
| 4.3.12 | 76/79 | Ac-LRMK-ava-LSLLDKIYTSPL-NH$_2$ | 157 |

Pos. is the residue position in the primary sequence of the first amino acid in the antigenic epitope. Ii-Key is the number of residue positions intervening between an Ii-Key motif and the first residue of the antigenic epitope.

TABLE 4.4

Experimentally defined Fel d 1 chain 1 MHC Class II-presented epitopes.

| PEPTIDE | Pos. | Sequence | Ii-Key | SEQ ID NO: |
|---|---|---|---|---|
| 4.4.1 | 20 | EICPAVKRDVDLFLTGT | — | 158 |
| 4.4.2 | 30 | LFLTGTPDEYVEQVAQY | — | 159 |
| 4.4.3 | 41 | EQVAQYKALPVVLENA | 10 | 160 |
| 4.4.4 | 47 | KALPVVLENARILKNCV | — | 161 |
| 4.4.5 | 57 | RILKNCVDAKMTEEDKE | 5 | 162 |
| 4.4.6 | 66 | KMTEEDKENALSLLDK | 2 | 163 |
| 4.4.7 | 72 | KENALSVLDKIYTSPL | — | 164 |

Pos. is the residue position in the primary sequence of the first amino acid in the antigenic epitope. Sequence is the amino acid sequence of certain peptides found to elicit responses in patients with allergy to cat dander (Haselden B M. J Exp Med. 1999 189: 1885-94). Ii-Key is the number of residue positions intervening between an Ii-Key motif and the first residue of the antigenic epitope. PEPTIDE 4.4.2 is from FC1P1; PEPTIDE 4.4.3 is from FC1P2; PEPTIDE 4.4.4 is from FC1P3 (Haselden B M. J Exp Med. 1999 189:1885-94).

TABLE 4.5

Designed Ii-Key/Fel d 1 (chain 1) hybrids containing some of the MHC Class II-presented epitopes of Table 4.4.

| PEPTIDE | Pos. | Sequence | SEQ ID NO: |
|---|---|---|---|
| 4.5.1 | 30 | Ac-LRMK-ava-LFLTGTPDEYVEQVAQY-$NH_2$ | 165 |
| 4.5.2 | 41 | Ac-LRMK-ava-EQVAQYKALPVVLENA-$NH_2$ | 166 |
| 4.5.3 | 47 | Ac-LRMK-ava-KALPVVLENARILKNCV-$NH_2$ | 167 |
| 4.5.4 | 57 | Ac-LRMK-ava-RILKNCVDAKMTEEDKE-$NH_2$ | 168 |
| 4.5.5 | 41/47/57 | Ac-LRMK-ava-QVAQYKALPVVLENARILKNCV DAKMTEEDKE-$NH_2$ | 169 |

Pos. is the residue position in the primary sequence of the first amino acid in the antigenic epitope. Ii-Key is the number of residue positions intervening between an Ii-Key motif and the first residue of the antigenic epitope.

TABLE 4.6

Predicted MHC Class II-presented epitopes of Fel d 1 (chain 2)

| PEPTIDE | Pos. | Sequence | Score | Ii-Key | SEQ ID NO: |
|---|---|---|---|---|---|
| 4.6.1 | 10 | LLVTQALGV | 6.10 | 3 | 170 |
| 4.6.2 | 40 | LLLDLSLTK | 4.60 | — | 171 |
| 4.6.3 | 79 | LVMTTISSS | 4.37 | — | 172 |
| 4.6.4 | 18 | VKMAETCPI | 4.80 | 11 | 173 |
| 4.6.5 | 5 | LVLALLVTQ | 4.50 | — | 174 |
| 4.6.6 | 4 | LLVLALLVT | 3.90 | — | 175 |

Pos. is the residue position in the primary sequence of the first amino acid in the antigenic epitope. Sequence is the amino acid sequence of the predicted MHC Class II-presented epitope. Score is the score reported by the ProPred program, for the relative likelihood of being presented by many common HLA-DR alleles. Ii-Key is the number of residue positions intervening between an Ii-Key motif and the first residue of the antigenic epitope.

TABLE 4.7

Designed Ii-Key/Fel d (chain 2) hybrids containing some of the MHC Class II-presented epitopes of Table 4.6.

| PEPTIDE | Pos. | Sequence | SEQ ID NO: |
|---|---|---|---|
| 4.7.1 | 9 | Ac-LRMK-ava-LLVTQALGV-$NH_2$ | 176 |
| 4.7.2 | 5 | Ac-LRMK-ava-LVLALLVTQ-$NH_2$ | 177 |
| 4.7.3 | 4 | Ac-LRMK-ava-LLVLALLVT-$NH_2$ | 178 |
| 4.7.4 | 4/5/9 | Ac-LRMK-ava-LLVLALLVTQALGV-$NH_2$ | 179 |
| 4.7.5 | 17 | Ac-LRMK-ava-VKMAETCPI-$NH_2$ | 180 |
| 4.7.6 | 39 | Ac-LRMK-ava-LLLDLSLTK-$NH_2$ | 181 |
| 4.7.7 | 78 | Ac-LRMK-ava-LVMTTISSS-$NH_2$ | 182 |

Pos. is the residue position in the primary sequence of the first amino acid in the antigenic epitope.

TABLE 4.8

Experimentally determined Fel d 1 (chain 2) MHC Class II-presented epitopes.

| PEPTIDE | Pos. | Sequence | Ii-Key | SEQ ID NO: |
|---|---|---|---|---|
| 4.8.1 | 46 | LTKVNATEPERTAMKK | — | 183 |
| 4.8.2 | 57 | TAMKKIQDCYVENGLI | 6 | 184 |
| 4.8.3 | 65 | CYVENGLISRVLDGLV | — | 185 |
| 4.8.4 | 84 | ISSSKDCMGEAVQNTV | 5 | 186 |
| 4.8.5 | 94 | AVQNTVEDLKLNTLGR | — | 187 |

Pos. is the residue position in the primary sequence of the first amino acid in the antigenic epitope. Sequence is the amino acid sequence of an experimentally determined MHC Class II-presented epitope. Ii-Key is the number of residue positions intervening between an Ii-Key motif and the first residue of the antigenic epitope.

TABLE 4.9

Designed Ii-Key/Fel d 1 (chain 2) hybrids containing some of the MHC Class II-presented epitopes of Table 4.8.

| PEPTIDE | Pos. | Sequence | SEQ ID NO: |
|---|---|---|---|
| 4.9.1 | 46 | Ac-LRMK-ava-LTKVNATEPERTAMKK-$NH_2$ | 188 |
| 4.9.2 | 57 | Ac-LRMK-ava-TAMKKIQDCYVENGLI-$NH_2$ | 189 |
| 4.9.3 | 65 | Ac-LRMK-ava-CYVENGLISRVLDGLV-$NH_2$ | 190 |
| 4.9.4 | 84 | Ac-LRMK-ava-ISSSKDCMGEAVQNTV-$NH_2$ | 191 |
| 4.9.5 | 57/65 | Ac-LRMK-ava-TAMKKIQDCYVENGLISRVLDGLV-$NH_2$ | 192 |

Pos. is the residue position in the primary sequence of the first amino acid in the antigenic epitope.

Example 5

Ii-Key/Ph1 p 1 Pollen Antigenic Epitope Hybrids

In another aspect this invention relates to the design and use of Ii-Key/Ph1 p 1 pollen antigenic epitope hybrids. Laffer and colleagues obtained the cDNA for the major allergen PhI p I from timothy grass (*Phleum pratense*) and found that the recombinant protein PhI p I inhibits IgE binding to group I allergens prepared form eight different grass species (Laffer S. J Allergy Clin Immunol. 1994 94:689-98). In a study of the T-cell epitopes of PhI p 1, major pollen allergen of timothy grass (*Phleum pratense*) Schenk S, and colleagues found evidence for crossreacting and non-crossreacting T-cell epitopes within grass group I allergens (Schenk S. J Allergy Clin Immunol. 1995 96:986-96). Immunological characterization of various purified recombinant timothy grass pollen (*Phleum pratense*) allergens (PhI p 1, PhI p2, PhI p 5) were characterized with respect to such cross reactions (Vrtala S. J Allergy Clin Immunol. 1996 97:781-7). Various nonanaphylactic synthetic peptides were obtained from antibody-recognized epitopes of the major grass pollen allergen, PhI p 1, for allergy vaccination (Focke M. FASEB J. 2001 15:2042-4). Some of these epitopes are incorporated in the Ii-Key/MHC Class II epitope/IgG epitope hybrids of Tables 5.7. In related work, Blaher et al. identified MHC Class II-presented epitopes of Lol p 9, a major allergen of ryegrass (*Lolium perenne*) pollen (Blaher B. J Allergy Clin Immunol. 1996 98:124-32).

The sequence of PhI p I allergen [*Phleum pratense*] in Table 5.1 was taken from Gen Bank 473360, PhI p I allergen. Predicted MHC class-II-presented epitopes of PhI p 1 are listed in Table 5.2. Ii-Key/PhI p 1 hybrids containing some of the MHC Class II-presented PhI p 1 epitopes of Table 5.2 are listed in Table 5.3. Experimentally defined MHC Class II-presented epitopes of PhI p 1 are listed in Table 5.4. Ii-Key/PhI p 1 hybrids containing some of the experimentally defined MHC Class II-presented epitopes of Table 5.4 are listed in Table 5.5. Experimentally defined IgE-binding epitopes of PhI p 1 overlapping with MHC Class II-presented PhI p 1 epitopes are listed in Table 5.6. A hybrid peptide including an experimentally defined MHC Class II and IgE binding Php 1 epitope is listed in Table 5.7.

TABLE 5.1

Deduced amino acid sequence of Phl p 1 pollen protein (SEQ ID NO: 193).

| | |
|---|---|
| 1 | massssvllv vvlfavflgs aygipkvppg pnitatygdk wldakstwyg |
| 51 | kptgagpkdn ggacgykdvd kppfsgmtgc gntpifksgr gcgscfeikc |
| 101 | tkpeacsgep vvvhitddne epiapyhfdl sghafgamak kgdeqklrsa |
| 151 | gelelqfrrv kckypegtkv tfhvekgsnp nylallvkyv ngdgdvvavd |
| 201 | ikekgkdkwi elkeswgaiw ridtpdkltg pftvrytteg gtkteaedvi |
| 251 | pegwkadtsy esk |

TABLE 5.2

Predicted MHC class II-presented epitopes of Phl p 1.

| PEPTIDE | 00Pos. | Sequence | Score | 00Ii-Key | SEQ ID NO: |
|---|---|---|---|---|---|
| 5.2.1 | 0 | MASSSSVLL | 6.30 | — | 194 |
| 5.2.2 | 220 | WRIDTPDKL | 5.86 | 5 | 195 |

TABLE 5.2-continued

Predicted MHC class II-presented epitopes of Phl p 1.

| PEPTIDE | 00Pos. | Sequence | Score | 00Ii-Key | SEQ ID NO: |
|---|---|---|---|---|---|
| 5.2.3 | 9 | VVVLFAVFL | 5.80 | — | 196 |
| 5.2.4 | 10 | VVLFAVLG | 6.00 | — | 197 |
| 5.2.5 | 6 | VLLVVVLFA | 5.10 | — | 198 |
| 5.2.6 | 96 | FEIKCTKPE | 5.80 | 6 | 199 |
| 5.2.7 | 15 | VFLGSAYGI | 4.80 | — | 200 |
| 5.2.8 | 186 | LVKYVNGDG | 4.50 | 9 | 201 |
| 5.2.9 | 185 | LLVKYVNGD | 4.50 | 8 | 202 |

Pos. is the residue position in the primary sequence of the first amino acid in the antigenic epitope. Sequence is the amino acid sequence of the predicted MHC Class II-presented epitope. Score is the score reported by the ProPred program, for the relative likelihood of being presented by many common HLA-DR alleles. Ii-Key is the number of residue positions intervening between an Ii-Key motif and the first residue of the antigenic epitope.

TABLE 5.3

Ii-Key/Phl p 1 hybrids containing some of the MHC Class II-presented Phl p 1 epitopes of Table 5.2.

| PEPTIDE | Pos. | Sequence | SEQ ID NO: |
|---|---|---|---|
| 5.3.1 | 0 | Ac-LRMK-ava-MASSSSVLL-NH$_2$ | 203 |
| 5.3.2 | 6 | Ac-LRMK-ava-VLLVVVLFA-NH$_2$ | 204 |
| 5.3.3 | 9 | Ac-LRMK-ava-VVVLFAVFL-NH$_2$ | 205 |
| 5.3.4 | 10 | Ac-LRMK-ava-VVLFAVFLG-NH$_2$ | 206 |
| 5.3.5 | 0/6/9/10 | Ac-LRMK-ava-MASSSSVLLVVVLFAVFLG-NH$_2$ | 207 |
| 5.3.6 | 219 | Ac-LRMK-ava-WRIDTPDKL-NH$_2$ | 208 |
| 5.3.7 | 95 | Ac-LRMK-ava-FEIKCTKPE-NH$_2$ | 209 |
| 5.3.8 | 15 | Ac-LRMK-ava-VFLGSAYGI-NH$_2$ | 210 |
| 5.3.9 | 184 | Ac-LRMK-ava-LLVKYVNGD-NH$_2$ | 211 |
| 5.3.10 | 185 | Ac-LRMK-ava-LVKYVNGDG-NH$_2$ | 212 |
| 5.3.11 | 184/185 | Ac-LRMK-ava-LLVKYVNGDG-NH$_2$ | 213 |

Pos. is the residue position in the primary sequence of the first amino acid in the antigenic epitope.

TABLE 5.4

Experimentally defined MHC Class II-presented epitopes of Phl p 1.

| PEPTIDE | Pos. | Sequence | Ii-Key | SEQ ID NO: |
|---|---|---|---|---|
| 5.4.1 | 96 | F E I K C T K P E A C S | 6 | 214 |
| 5.4.2 | 123 | I A P Y H F D L S G H A | 5 | 215 |

Pos. is the residue position in the primary sequence of the first amino acid in the antigenic epitope. Ii-Key is the number of residue positions intervening between an Ii-Key motif and the first residue of the antigenic epitope.

The experimentally defined MHC Class II epitopes of PhI p 1, cross react within grass group I allergens—Lol p 1 (ryegrass, *Lolium perenne*), Sec c 1 (rye, *secale cereale*) (Schenk S. J Allergy Clin Immunol. 1995 96:986-96). Specifically the epitope of PEPTIDE 5.4.1 cross reacts with Lol p 1 (A97 is replaced by S97) and cross reacts with Sec c 1 (189 is replaced by L89). The epitope of PEPTIDE 5.4.2 cross reacts with Lol p 1 and sec c 1 (A124 is replaced by D124).

TABLE 5.5

Ii-Key/Phl p 1 hybrids containing some of the experimentally defined MHC Class II-presented epitopes of Table 3.

| PEPTIDE | Pos. | Sequence | SEQ ID NO: |
|---|---|---|---|
| 5.4.1 | 96 | Ac-LRMK-ava-FEIKCTKPEACS-NH$_2$ | 216 |
| 5.4.2 | 123 | Ac-LRMK-ava-IAPYHFDLSGHA-NH$_2$ | 217 |

Pos. is the residue position in the primary sequence of the first amino acid in the antigenic epitope. Ii-Key is the number of residue positions intervening between an Ii-Key motif and the first residue of the antigenic epitope.

TABLE 5.6

Experimentally defined IgE-binding epitopes of Phl p 1 overlapping with MHC Class II-presented Phl p 1 epitopes.

| PEPTIDE | Pos. | Sequence | SEQ ID NO: |
|---|---|---|---|
| 5.6.1 | 24 | IPKVPPG PNITATYGDK WLDAKSTWYG KPT | 218 |
| 5.6.2 | 65 | GYKDVD KPPFSGMTGC GNTPIFKSGR G | 219 |
| 5.6.3 | 109 | EP VVVHITDDNE EPIAPYHFDLSGHAFGAMA | 220 |
| 5.6.4 | 173 | HVEKGSNP NYLALLVKYV NGDGDVVAV | 221 |
| 5.6.5 | 235 | RYTTEG GTKTEAEDVI PEGWKADTSY ESK | 222 |

Pos. is the residue position in the primary sequence of the first amino acid in the antigenic epitope. Ii-Key is the number of residue positions intervening between an Ii-Key motif and the first residue of the antigenic epitope. The peptides containing IgE-binding epitopes were defined by Focke and colleagues (Focke M. FASEB J. 2001 15:2042-4). PEPTIDE 5.6.3 includes experimentally defined MHC Class II epitopes of PhI p 1 (Schenk S. J Allergy Clin Immunol. 1995 96:986-96) overlapping with IgE epitope containing peptides (Focke M. FASEB J. 2001 15:2042-4).

TABLE 5.7

A hybrid peptide including an experimentally defined MHC Class II and IgE binding Php 1 epitope.

| PEPTIDE | Pos. | Sequence | SEQ ID NO: |
|---|---|---|---|
| 5.7.1 | 109 | Ac-LRMK-ava-FEIKCTKPEACSGEPVVVHITDDNE EPIAPYHFDLSGHAFGAMA-NH$_2$ | 223 |

Pos. is the residue position in the primary sequence of the first amino acid in the antigenic epitope. Ii-Key is the number of residue positions intervening between an Ii-Key motif and the first residue of the antigenic epitope. PEPTIDE 5.7.1 includes PhI p 1 experimentally defined IgE epitopes (Focke M. FASEB J. 2001 15:2042-4) and experimentally defined MHC Class II epitopes of PhI p 1 (Schenk S. J Allergy Clin Immunol. 1995 96:986-96).

Example 6

Ii-Key/PhI p 5a Birch Pollen Antigenic Epitope Hybrids

In another aspect this invention relates to the design and use of Ii-Key/PhI p 5a birch pollen antigenic epitope hybrids. Multiple T cell epitopes on Bet v I, the major birch pollen allergen, have been determined using specific T cell clones and overlapping peptides (Ebner C. J Immunol. 1993 150: 1047-54). Vrtala and colleagues found that the major birch pollen allergen, Bet v 1, can be divided into two fragments each of which contained nonanaphylactic T cell epitopes and are candidates for suppressive immunotherapy (Vrtala S. Int Arch Allergy Immunol. 1997 113:246-8; Vrtala S. J Clin Invest. 1997 99:1673-81). Friedl-Hajek R. and colleagues characterized a highly promiscuous, HLA allele-specific T-cell epitope in the birch major allergen Bet v 1 Five Bet v 1-specific T cell clones derived from two birch pollen-allergic individuals and specific for Bet v 1 (Friedl-Hajek R. Clin Exp Allergy. 1999 29:478-87). One of these T cell clones reacted with a Bet v 1 peptide containing amino acid residues 21-33 (BP21), the other two T cell clones reacted with a minimal peptide containing residues 37-45 (BP37). While BP37-specific T cell clones were restricted by a HLA-DQA1*0301/DQB1*0603 heterodimer, BP21 was recognized in a highly promiscuous manner. T cell clones recognizing this sequence were restricted by HLA-DPB1*0201, a HLA-DQA1*0201/DQB1*0201 heterodimer, or HLA-DRB3*0101.

The sequence of Phl p 5a birch pollen protein in Table 6.1 was taken from GenBank 2851456 (Bufe A. J Allergy Clin Immuno. 1994 94:173-81). Predicted MHC Class II-presented epitopes of PhI p 5a are listed in Table 6.2. Experimentally defined, cross reacting MHC Class II isoepitopes of PhI p 5a and PhI p 5b are listed in Table 6.3 (Muller W. Clin Exp Allergy. 1998 28:1538-48). Designed Ii-Key/antigenic epitope hybrids containing PhI p 5 MHC Class II-presented epitopes are listed in Table 6.4.

TABLE 6.1

Deduced amino acid sequence of Phl p 5a birch pollen. (SEQ ID NO: 224)

```
1  adlgygpatp aapaagytpa tpaapagada agkatteeqk
   liekinagfk
```

TABLE 6.1-continued

Deduced amino acid sequence of Phl
p 5a birch pollen. (SEQ ID NO: 224)

```
 51 aalagagvqp adkyrtfvat fgpasnkafa eglsgepkga
    aessskaalt 101 skldaaykla yktaegatpe akydayvatl sealriiagt
    levhavkpaa 151 eevkvipage lqviekvdaa fkvaataana apandkftvf
    eaafndeika 201 stggayesyk fipaleaavk qayaatvata pevkytvfet
    alkkaitams 251 eaqkaakpaa aatatataav gaatgaataa tggykv
```

TABLE 6.2

Predicted MHC Class II-presented epitopes
of Phl p 5a.

| PEPTIDE | Pos. | Sequence | Score | Ii-Key | SEQ ID NO: |
|---|---|---|---|---|---|
| 6.2.1 | 126 | Y V A T L S E A L | 8.40 | — | 225 |
| 6.2.2 | 153 | V K V I P A G E L | 5.10 | 5 | 226 |
| 6.2.3 | 134 | L R I I A G T L E | 5.00 | — | 227 |
| 6.2.4 | 209 | Y K F I P A L E A | 4.80 | — | 228 |
| 6.2.5 | 206 | Y E S Y K F I P A | 4.00 | — | 229 |
| 6.2.6 | 171 | F K V A A T A A N | 4.10 | 2 | 230 |
| 6.2.7 | 64 | Y R T F V A T F G | 4.00 | — | 231 |

Pos. is the residue position in the primary sequence of the first amino acid in the antigenic epitope. Sequence is the amino acid sequence of the predicted MHC Class II-presented epitope. Score is the score reported by the ProPred program, for the relative likelihood of being presented by many common HLA-DR alleles. Ii-Key is the number of residue positions intervening between an Ii-Key motif and the first residue of the antigenic epitope.

TABLE 6.3

Experimentally defined, cross reacting MHC
Class II isoepitopes of Phl p 5a and Phl p
5b.

| PEPTIDE | Pos. | Sequence | Ii-Key | SEQ ID NO: |
|---|---|---|---|---|
| 6.3.1 | 209 | Y K F I P A L E A A V K | — | 232 |
| 6.3.2 | 161 | L Q V I E K V D A A F K | 2 | 233 |

Pos. is the residue position in the primary sequence of the first amino acid in the antigenic epitope. Sequence is the amino acid sequence of an experimentally determined MHC Class II-presented epitope. Ii-Key is the number of residue positions intervening between an Ii-Key motif and the first residue of the antigenic epitope. PEPTIDE 6.3.1 corresponds to peptide Phl p 5b(184-195; YKCIPSLEAAVK) (SEQ ID NO: 234) and PEPTIDE 6.3.2 corresponds to peptide Phl p 5b(136-147; LQIIDKIDAAFK (SEQ ID NO: 235) (Muller W. Clin Exp Allergy. 1998 28:1538-48).

TABLE 6.4

Hybrids containing Phl p 5 MHC Class
II-presented epitopes.

| PEPTIDE | Pos. | Sequence | SEQ ID NO: |
|---|---|---|---|
| Non-overlapping epitopes. | | | |
| 6.4.1 | 126 | Ac-LRMK-ava-YVATLSEAL-NH$_2$ | 236 |
| 6.4.2 | 153 | Ac-LRMK-ava-VKVIPAGEL-NH$_2$ | 237 |
| 6.4.3 | 134 | Ac-LRMK-ava-LRIIAGTLE-NH$_2$ | 238 |
| 6.4.4 | 64 | Ac-LRMK-ava-YRTFVATFG-NH$_2$ | 239 |
| B. Overlapping epitopes | | | |
| 6.4.5 | 209 | Ac-LRMK-ava-YKFIPALEA-NH$_2$ | 240 |
| 6.4.6 | 206 | Ac-LRMK-ava-YESYKFIPA-NH$_2$ | 241 |
| 6.4.7 | 206/209 | Ac-LRMK-ava-YESYKFIPALEA-NH$_2$ | 242 |
| 6.4.8 | 161 | Ac-LRMK-ava-LQVIEKVDAAFK-NH$_2$ | 243 |
| 6.4.9 | 171 | Ac-LRMK-ava-FKVAATAAN-NH$_2$ | 244 |
| 6.4.10 | 161/171 | Ac-LRMK-ava-LQVIEKVDAAFKVAATAAN-NH$_2$ | 245 |

Pos. is the residue position in the primary sequence of the first amino acid in the antigenic epitope. Ii-Key is the number of residue positions intervening between an Ii-Key motif and the first residue of the antigenic epitope.

Example 7

Ii-Key/Phospholipase A-2 Bee Venom Antigenic Epitope Hybrids

In another aspect this invention relates to the design and use of Ii-Key/Phospholipase A-2 bee venom antigenic epitope hybrids. Muller and colleagues successful induced specific T-cell anergy in patients allergic to bee venom with immunotherapy with T-cell recognized peptides of bee venom phospholipase A2 (Muller U. J Allergy Clin Immunol. 1998 101: 747-54). Five patients with IgE-mediated systemic allergic reactions to bee stings were treated with a mixture of three T-cell epitope peptides of PLA. Ten patients allergic to BV receiving whole BV immunotherapy served as control subjects. Increasing doses of the peptide mixture, up to a maintenance dose of 100 micrograms, were administered subcutaneously within 2 months. The patients were then challenged with PLA and 1 week later with a bee sting. The cellular and humoral immune response was measured in vitro. No allergic side effects were caused by the peptide immunotherapy, and all patients tolerated the challenge with PLA without systemic allergic symptoms. Two patients developed mild systemic allergic reactions after the bee sting challenge. After peptide immunotherapy, specific proliferative responses to PLA and the peptides in peripheral blood mononuclear cells were decreased in successfully treated patients. The production of TH2 and TH1 cytokines was inhibited, and B cells were not affected in their capacity to produce specific IgE and IgG4 antibodies. Their levels increased after allergen challenge in favor of IgG4. The investigators concluded that immunotherapy of BV allergy with short T-cell peptides of PLA induces epitope-specific anergy in peripheral T cells and changes the specific isotype ratio in a fashion similar to that of conventional immunotherapy in successfully treated patients. Additional MHC Class II-presented candidate epitopes have been identified (Texier C. J Immunol 2000 164:3177-84).

The sequence of bee venom phospholipase A-2 in Table 7.1 was taken from GenBank 129501 allergen Api m1 (Kuchler K. Eur J Biochem. 1989 184:249-54). Predicted MHC Class II-presented epitopes of the major bee venom allergen phospholipase A-2 are listed in Table 7.2. Table 7.3. Experimentally defined MHC Class II-presented epitopes of the major bee venom allergen phospholipase A-2 are listed in Table 7.3. Ii-Key/PHL A2 hybrids containing some of the MHC Class II-presented PHL A2 epitopes of Table 1 and 2 (nonoverlapping and overlapping epitopes) are listed in Table 7.4.

TABLE 7.1

| Deduced amino acid sequence of Phospholipase A-2 bee venom. (SEQ ID NO: 246) |
|---|
| 1gslfllllst shgwqirdri gdneleerii ypgtlwcghg nk ssgpnelg |
| 51rfkhtdaccr thdmcpdvms ageskhgltn tashtrlscd cd dkfydclk |
| 101nsadtissyf vgkmyfnlid tkcyklehpv tgcgertegr cl hytvdksk |
| 151pkvyqwfdlr ky |

TABLE 7.2

Predicted MHC Class II-presented epitopes of the major bee venom allergen Phospholipase A-2.

| PEPTIDE | Pos. | Sequence | Score | Ii-Key | SEQ ID NO: |
|---|---|---|---|---|---|
| 7.2.1 | 14 | W Q I R D R I G D | 7.80 | — | 247 |
| 7.2.1 | 4 | F L L L L S T S H | 5.70 | — | 248 |
| 7.2.1 | 110 | F V G K M Y F N L | 5.50 | — | 249 |
| 7.2.1 | 118 | L I D T K C Y K L | 5.30 | — | 250 |
| 7.2.1 | 6 | L L L S T S H G W | 4.80 | — | 251 |
| 7.2.1 | 116 | F N L I D T K C Y | 4.50 | — | 252 |
| 7.2.1 | 5 | L L L L S T S H G | 4.40 | — | 253 |
| 7.2.1 | 52 | F K H T D A C C R | 4.10 | — | 254 |
| 7.2.1 | 124 | Y K L E H P V T G | 4.08 | — | 255 |

Pos. is the residue position in the primary sequence of the first amino acid in the antigenic epitope. Sequence is the amino acid sequence of the predicted MHC Class II-presented epitope. Score is the score reported by the ProPred program, for the relative likelihood of being presented by many common HLA-DR alleles. Ii-Key is the number of residue positions intervening between an Ii-Key motif and the first residue of the antigenic epitope.

TABLE 7.3

Experimentally defined MHC Class II-presented epitopes of the major bee venom allergen Phospholipase A-2.

| PEPTIDE | Pos. | Sequence | Ii-Key | SEQ ID NO: |
|---|---|---|---|---|
| 7.3.1 | 113 | K M Y F N L I D T K C Y K | — | 256 |
| 7.3.2 | 122 | K C Y K L E H P V T G C G | 4 | 257 |
| 7.3.3 | 109 | Y F V G K M Y F N L I D T | — | 258 |
| 7.3.4 | 141 | C L H Y T V D K S K P K | 10 | 259 |
| 7.3.5 | 73 | E S K H G L T N T A S H T RLSCD | — | 260 |

Pos. is the residue position in the primary sequence of the first amino acid in the antigenic epitope. Sequence is the amino acid sequence of an experimentally determined MHC Class II-presented epitope. Ii-Key is the number of residue positions intervening between an Ii-Key motif and the first residue of the antigenic epitope. The above epitopes were defined by Texier and colleagues and Carballido and colleagues (Texier C. J Immunol. 2000 164:3177-84; Carballido J. J Immunol. 1993 150:3582-91).

posed of multiple tandem amino-acid repeats. Two consecutive repeats are not identical but form a duplex that constitutes a basic molecular unit of Bla g 1 (Pomes A. Am J Respir Crit Care Med, 2002 165:391-7). The presence of two repeats was not a requirement for IgE antibody binding (Pomes A. Eur J Biochem. 2002 269:3086-3092). That fact supports the view that single linear chains of one repeat in the antigen can be found to express IgE binding epitopes. Bla g 2 is one of the most potent cockroach allergens (prevalence of IgE responses

TABLE 7.4

Ii-Key/PHL A2 hybrids containing some of the MHC Class II-presented PHL A2 epitopes of Table 1 and 2.

| PEPTIDE | Pos. | Sequence | SEQ ID NO: |
|---|---|---|---|
| | | Nonoverlapping epitopes | |
| 7.4.1 | 14 | Ac-LRMK-ava-WQIRDRIGD-NH$_2$ | 261 |
| 7.4.2 | 52 | Ac-LRMK-ava-FKHTDACCR-NH$_2$ | 262 |
| | | Overlapping epitopes | |
| 7.4.3 | 4 | Ac-LRMK-ava-FLLLLSTSH-NH$_2$ | 263 |
| 7.4.4 | 5 | Ac-LRMK-ava-LLLLSTSHG-NH$_2$ | 264 |
| 7.4.5 | 6 | Ac-LRMK-ava-LLLSTSHGW-NH$_2$ | 265 |
| 7.4.6 | 4/5/6 | Ac-LRMK-ava-FLLLLSTSHGW-NH$_2$ | 266 |
| 7.4.7 | 110 | Ac-LRMK-ava-FVGKMYFNL-NH$_2$ | 267 |
| 7.4.8 | 116 | Ac-LRMK-ava-FNLIDTKCY-NH$_2$ | 268 |
| 7.4.9 | 118 | Ac-LRMK-ava-LIDTKCYKL-NH$_2$ | 269 |
| 7.4.10 | 110/116/118 | Ac-LRMK-ava-FVGKMYFNLIDTKCYKL-NH$_2$ | 270 |

Pos. is the residue position in the primary sequence of the first amino acid in the antigenic epitope. Ii-Key is the number of residue positions intervening between an Ii-Key motif and the first residue of the antigenic epitope.

Example 8

Bla g 5 Glutathione-S-Transferase (GST) Cockroach Antigenic Epitope Hybrids

In another aspect this invention relates to the design and use of Ii-Key/Bla g 5 glutathione-S-transferase (GST) cockroach antigenic epitope hybrids. Sensitization to cockroach allergens is associated with the development of asthma. This antigenic protein was found to induce positive skin test reactions in 70% of patients who are allergic to cockroaches. A 23-kDa allergen, glutathione S-transferase (EC 2.5.1.18; GST) was purified from German cockroach (*Blattella germanica*) by glutathione affinity chromatography (Arruda L K. J Biol Chem. 1997 272:20907-12). The purified protein and recombinant protein had a high level of IgE antibody binding activity. This GST caused positive immediate skin tests in cockroach-allergic patients using as little as 3 pg of recombinant protein. Bla g 1 and has a molecular structure comof 60 to 80%) and shows homology to the aspartic proteinase family of enzymes. Mutational destruction of the enzymatic activity did not alter allergenicity (Pomes A. Am J Respir Crit Care Med, 2002 165:391-7). Recombinant proteins of cockroach allergens Bla g 2, Bla g 4 and Bla g 5 and mite group 5 allergens were produced in bacterial expression vectors and demonstrated strong immediate skin and serum IgE antibody responses in cockroach-allergic patients (Chapman M D. Int Arch Allergy Immunol. 1997 113:102-4). Each of the recombinant allergens retained biologic activity and the investigators suggested that cocktails of two to four recombinant allergens could be used for diagnostic or therapeutic purposes. No dominant linear IgE-binding epitopes have been reported, but when they become determined, Ii-Key/Bla g MHC Class II epitope/BLA g IgE-recognized hybrid peptides can be designed and tested.

The sequence of cockroach allergen BLA g 5 in Table 8.1 was taken from GenBank 6225491 (Arruda L K. J Biol Chem. 1997 272:20907-12). Predicted MHC Class II epitopes of cockroach allergen Bla g 5 are presented in Table 8.2. Experimentally defined MHC Class II epitopes of Bla g 5 (Papouchado B G. Tissue Antigens. 2000 55:303-11) are presented in Table 8.3.

TABLE 8.1

Deduced amino acid sequence of cockroach allergen Bla g 5.
(SEQ ID NO: 271)

```
  1 mapsykltyc pvkalgepir fllsygekdf edyrfqegdw pnlkpsmpfg
 51 ktpvleidgk qthqsvaisr ylgkqfglsg kddwenleid mivdtisdfr
151 aaianyhyda denskqkkwd plkketipyy tkkfdevvka nggylaagkl
201 twadfyfvai ldylnhmake dlvanqpnlk alrekvlglp aikawvakrp
251 ptdl
```

TABLE 8.2

Predicted MHC Class II-presented epitopes of cockroach allergen Bla g 5.

| PEPTIDE NO: | Pos. | Sequence 1 2 3 4 5 6 7 8 9 | Score | Ii-Key | SEQ ID NO: |
|---|---|---|---|---|---|
| 8.2.1 | 49 | F G K T P V L E I | 7.60 | — | 272 |
| 8.2.2 | 245 | W V A K R P P T D | 5.85 | — | 273 |
| 8.2.3 | 91 | M I V D T I S D F | 5.57 | — | 274 |
| 8.2.4 | 205 | F Y F V A I L D Y | 5.40 | — | 275 |
| 8.2.5 | 19 | I R F L L S Y G E | 5.10 | 2 | 276 |
| 8.2.6 | 55 | L E I D G K Q T H | 4.60 | 7 | 277 |
| 8.2.7 | 99 | F R A A I A N Y H | 4.20 | — | 278 |

Pos. is the residue position in the primary sequence of the first amino acid in the antigenic epitope. Sequence is the amino acid sequence of the predicted MHC Class II-presented epitope. Score is the score reported by the ProPred program, for the relative likelihood of being presented by many common HLA-DR alleles. Ii-Key is the number of residue positions intervening between an Ii-Key motif and the first residue of the antigenic epitope.

TABLE 8.3

Experimentally defined MHC Class II epitopes of Bla g 5.

| PEPTIDE NO: | Pos. | Sequence | Ii-Key | SEQ ID NO: |
|---|---|---|---|---|
| 8.3.1 | 92 | IVDTISDFRAAIANYHYDAD | — | 279 |
| 8.3.1 | 212 | DYLNHMAKEDLVANQPNLKA | — | 280 |

Pos. is the residue position in the primary sequence of the first amino acid in the antigenic epitope. Sequence is the amino acid sequence of an experimentally determined MHC Class II-presented epitope. Ii-Key is the number of residue positions intervening between an Ii-Key motif and the first residue of the antigenic epitope.

Example 9

Ii-Key/CEA Antigenic Epitope Hybrids

Carcinoembryonic antigen (CEA) is a tumor associated antigen (TAA) that is expressed in tumors including colon, breast and pancreas. The protein and the cDNA have been used for therapeutic tumor vaccines. A recombinant vaccinia-CEA vaccine has been used to generation cytotoxic T cells specific for human carcinoembryonic antigen epitopes (Tsang K Y. J Natl Cancer Inst. 1995 87:982-90). Ii-Key hybrids can be used to develop T helper cell responses to this tumor-associated antigen prior to DNA vaccines of any form. Thus, the clinical value of such a recombinant vaccinia-CEA construct can be enhanced substantially with the products and methods of this invention, as described in this disclosure. Additional CEA vaccination procedures, in which Ii-Key/CEA antigenic epitope hybrids can be applied, are presented below.

Reisfeld and colleagues demonstrated that an oral DNA vaccine against human CEA prevented growth and dissemination of Lewis lung carcinoma in CEA transgenic mice (Niethammer A G. Vaccine 2001 20:421-9). A DNA vaccine encoding human CEA broke peripheral T-cell tolerance toward this antigen expressed by Lewis lung carcinoma stably transduced with CEA in C57BL/6J mice transgenic for CEA. The vaccine was delivered by oral gavage with an attenuated strain of *Salmonella typhimurium* (SL7207), and boosted with an antibody-IL2 fusion protein. Both CTL and antigen-presenting dendritic cells were activated as indicated by a decisive increase in their respective activation markers CD2, CD25, CD28 as well as CD48 and CD80.

Stevenson and colleagues demonstrated that DNA fusion vaccine including MHC Class II epitopes of tetanus toxoid along with a tumor antigen of interest (here CEA) induced cytotoxic T cell responses against defined peptides. Fusion of the fragment C of tetanus toxin to a CEA sequence promoted antibody and CD4+ T cell responses against tested B cell tumors. Using only the first domain of tetanus toxoid, which contains a "universal" helper epitope, followed by two known CTL-recognized epitopes of CEA, they found strong CTL responses to each CTL-recognized peptide to be induced by the engineered construct.

Diagnostic assays with Ii-Key/antigenic epitope hybrids can be used to monitor therapy and predict outcomes in patients with CEA-positive tumors, as indicated from the following study. PBMC from two CEA-based vaccine clinical trials were analyzed for T cell responses to the same CEA peptide and to an influenza (Flu) control peptide (Arlen P. Cancer Immunol Immunother. 2000 49:517-29). The first trial consisted of three monthly vaccinations of CEA peptide (designated PPP) in adjuvant. The second trial consisted of cohorts receiving three monthly vaccinations of avipox-CEA recombinant (designated AAA) or cohorts receiving a primary vaccination with recombinant vaccinia-CEA followed by two monthly vaccinations with avipox-CEA (designated VAA). Few, if any, CEA-specific T cell responses were seen in patients receiving PPP vaccinations, while the majority of patients receiving the poxvirus CEA recombinants demonstrated increases in CEA-specific T cell responses and no increases in Flu-specific responses. CEA-specific IgG responses developed in patients following recombinant CEA poxvirus vaccinations. T cell responses to the CEA peptide were significantly increased after immunization with the recombinant poxvirus vaccine, as compared with the peptide vaccine (p=0.028). Clearly poxvirus recombinant-based vaccines are more potent in initiating tumor-antigen-specific T cell responses than are peptide vaccines. Their activity can be further enhanced, by prior vaccination with Ii-Key/CEA antigenic epitope hybrids.

In the case of tumor antigens such as CEA, Ii-Key/MHC Class II-presented antigenic epitope hybrids create T helper cell responses that augment the development of immune responses to CEA MHC Class I epitopes, for example through dendritic cell licensing. Such CTL activation by MHC Class I epitopes can be generated also by incorporating such MHC Class I epitopes in an Ii-Key MHC Class II-presented hybrids. Several MHC Class I epitope of CEA have been experimentally determined (Kawashima I. Hum Immunol. 1998 59:1-14; Nukaya I. Int J Cancer. 1999 80:92-7; Table 5). Such peptides have been discovered by various techniques. Nested deletions of the cDNA for the antigen of interest lead to protein products, which can be assayed for stimulation of CD8+ cells lines, which recognize the antigen. Given various cell lines recognizing individual epitopes, the localization of T cell epitopes can be approximated within the primary sequence, by analyzing the reactions of each T cell clone to the nested deletion cDNA constructs. Then a library of overlapping peptides through biologically active target regions can be assayed to define exactly the individual determinants. The binding of such peptides to immunopurified MHC Class I molecules can also be assayed, for example by inhibition of binding of a radiolabeled standard peptide to MHC molecules (Kawashima I. Hum Immunol. 1998 59:1-14). The MHC Class I molecules can be immunopurified and bound into microtiter plates, in which the various components of the assay are added sequentially, with appropriate washings. Alternatively the MHC Class I molecules can be detergent-solubilized without purification, for example from a microsomal membrane preparation of a cultured lymphoblastoid cell line, and the complexes separated in a gel filtration column, with the bound radioactive peptide being separated in the protein complexes from the unbound, free peptide. In the work of Kawashima, initial studies were performed with HLA-A2.1 molecules. The highly reactive peptide 9.5.2, which induced vigorous anti-tumor CTL responses, also bound tightly to other common HLA alleles of the A2 supertype (A2.2, A2.3, A2.6 and A6802), thus demonstrating a potential in providing broad and not ethnically biased population coverage. CTL lines were used to identify peptides 9.5.4 and 9.5.6, which elicited CTL lines that lysed tumor cells expressing HLA-A24 and CEA. The cytotoxicity to tumor cells by the CTL lines was antigen-specific since it was inhibited by peptide-pulsed cold target cells as well as by monoclonal antibodies to MHC Class I and CD3 molecules. Similar methods can be used to characterize the biological responses induced by Ii-Key/MHC Class II epitope/MHC Class I epitope hybrids of this disclosure.

Alternatively, such peptides are identified with algorithms for the prediction of MHC Class I and Class II T cell-recognized epitopes (Lu J. Cancer Res. 2000 60:5223-7). These computer-based predictive algorithms, which are available on the Internet (Parker K C. J. Immunol. 1992 149:3580-7; Rammensee H G. Immunogenetics. 1995 41:178-228), were used to identify HL4-B7-restricted CTL epitopes for carcinoembryonic antigen (CEA). Of three candidate peptides, CEA9 (632) (IPQQHTQVL) (SEQ ID NO: 281) induced primary CTL responses in lymphocytes from HLA-B7+ normal blood donors when dendritic cells were used as antigen-presenting cells. These CTLs were efficient in killing tumor cells that expressed HLA-B7 and produced CEA.

Cell lines reflecting the natural T-cell response against MHC Class I epitopes of epithelial cell adhesion molecule, Her-2/neu, and carcinoembryonic antigen in patients with colorectal cancer have been used to identify the respective antigenic epitopes (Nagorsen D. Cancer Res. 2000 60:4850-4). Antigens of epithelial cell adhesion molecule (Ep-CAM), her-2/neu, and CEA were potential targets in antigen-specific vaccination-based cancer therapy. The investigators tested whether a natural specific T-cell response against these antigens already exists in patients with colorectal carcinoma. The IFN-gamma ELISPOT assay was used to detect circulating TAA-reactive T cells directly ex vivo in unstimulated peripheral blood mononuclear cells. They determined that seven of 22 patients, but none of the 8 healthy subjects, had T cells specifically secreting IFN-gamma in response to antigen peptides (n=4, Ep-CAM; n=5, her-2/neu; n=6, CEA). T-cell responses occurred only in patients with metastatic disease (Dukes' stages C and D). The results of this study indicate that natural T-cell responses against tumor antigens occur in approximately one-half of colorectal carcinoma patients with involvement of lymph nodes or distant metastases, but not in colorectal carcinoma patients with disease confined to the bowel tract. Ii-Key/antigenic epitope hybrids containing MHC Class II epitopes can be used to vaccinate patients with localized and metastatic disease against their tumors.

The amino acid sequence of CEA was obtained from GenBank as 11386171 carcinoembryonic antigen-related cell adhesion molecule 5; carcinoembryonic antigen [*Homo sapiens*] (Table 1). The primary sequence of human carcinoembryonic antigen (CEA) was deduced from cDNA sequence (Oikawa S. Biochem Biophys Res Commun. 1987 142:511-8). The carcinoembryonic antigen (CEA) contains multiple immunoglobulin-like domains (Oikawa S. Biochem Biophys Res Commun. 1987 144:634-42). Predicted MHC Class II-presented epitopes of CEA are listed in Table 9.2. Designed Ii-Key/CEA hybrids containing some of the MHC Class II-presented epitopes of CEA in Table 9.2 are listed in Table 9.3. Predicted MHC Class I-presented CEA epitopes are listed in Table 9.4. Experimentally defined MHC Class I epitopes of CEA are listed in Table 9.5. Ii-Key/MHC Class II/MHC Class I CEA hybrids are listed in Table 9.6.

TABLE 9.1

(SEQ ID NO: 282)
Deduced amino acid sequence of CEA.

```
  1 mespsapphr wcipwqrlll taslltfwnp pttaklties tpfnvaegke 51 vlllvhnlpq hlfgyswykg ervdgnrqii gyvigtqqat pgpaysgrei 101 iypnaslliq niiqndtgfy tlhviksdlv neeatgqfrv ypelpkpsis 151 snnskpvedk davaftcepe tqdatylwwv nnqslpvspr lqlsngnrtl
```

TABLE 9.1-continued (SEQ ID NO: 282)
Deduced amino acid sequence of CEA.

```
201 tlfnvtrndt asykcetqnp vsarrsdsvi lnvlygpdap tisplntsyr
251 sgenlnlsch aasnppaqys wfvngtfqqs tqelfipnit vnnsgsytcq
301 ahnsdtglnr ttvttitvya eppkpfitsn nsnpvededa valtcepeiq
351 nttylwwvnn qslpvsprlq lsndnrtltl lsvtrndvgp yecgiqnels
401 vdhsdpviln vlygpddpti spsytyyrpg vnlslschaa snppaqyswl
451 idgniqqhtq elfisnitek nsglytcqan nsasghsrtt vktitvsael
501 pkpsissnns kpvedkdava ftcepeaqnt tylwvvngqs lpvsprlqls
551 ngnrtltlfn vtrndarayv cgiqnsvsan rsdpvtldvl ygpdtpiisp
601 pdssylsgan lnlschsasn pspqyswrin gipqqhtqvl fiakitpnnn
651 gtyacfvsnl atgrnnsivk sitvsasgts pglsagatvg imigvlvgva
701 li
```

TABLE 9.2

Predicted MHC Class II-presented epitopes of CEA.

| PEPTIDE | Pos. | Sequence | Score | Ii-Key | SEQ ID NO: |
|---|---|---|---|---|---|
| 9.2.1 | 427 | YRPGVNLSL | 6.40 | — | 283 |
| 9.2.2 | 535 | WVNGQSLPV | 6.30 | — | 284 |
| 9.2.3 | 179 | WVNNQSLPV | 5.50 | — | 285 |
|  | 357 |  | 6.30 |  |  |
| 9.2.4 | 627 | WRINGIPQQ | 5.80 | — | 286 |
| 9.2.5 | 249 | YRSGENLNL | 5.50 | — | 287 |
| 9.2.6 | 52 | LLLVHNLPQ | 5.40 | — | 288 |
| 9.2.7 | 449 | WLIDGNIQQ | 5.10 | 12 | 289 |
|  |  |  | 5.78 |  |  |
| 9.2.8 | 591 | YGPDTPIIS | 5.10 | — | 290 |
| 9.2.9 | 119 | FYTLHVIK S | 5.10 | — | 291 |
| 9.2.10 | 79 | IIGYVIGTQ | 5.00 | — | 292 |

Pos. is the residue position in the primary sequence of the first amino acid in the antigenic epitope. Sequence is the amino acid sequence of the predicted MHC Class II-presented epitope. Score is the score reported by the ProPred program, for the relative likelihood of being presented by many common HLA-DR alleles. Ii-Key is the number of residue positions intervening between an Ii-Key motif and the first residue of the antigenic epitope.

TABLE 9.3

Designed Ii-Key/CEA hybrids containing some of the MHC Class II-presented epitopes of CEA in Table 9.2.
Non-overlapping epitopes

| PEPTIDE | Pos. | Sequence | SEQ ID NO: |
|---|---|---|---|
| 9.3.1 | 179 357 535 | Ac-LRMK-ava-WVNNQSLPV-NH$_2$ | 293 |
| 9.3.2 | 427 | Ac-LRMK-ava-YRPGVNLSL-NH$_2$ | 294 |
| 9.3.3 | 627 | Ac-LRMK-ava-WRINGIPQQ-NH$_2$ | 295 |
| 9.3.4 | 249 | Ac-LRMK-ava-YRSGENLNL-NH$_2$ | 296 |

Pos. is the residue position in the primary sequence of the first amino acid in the antigenic epitope. Sequence is the amino acid sequence of a hybrid peptide containing a MHC Class II epitope of Table 9.2. CEA contains seven extracellular domains, which are strikingly homologous to each other. This fact explains the repeated identical epitopes that starts at positions 178, 356, and 534 in this Table (Oikawa S. Biochem Biophys Res Commun. 187 144:634-42).

TABLE 9.4

Predicted MHC Class I-presented CEA epitopes.

| PEPTIDE | Pos. | Sequence | Score | SEQ ID NO: |
|---|---|---|---|---|
| 9.4.1 | 61 | HLFGYSWYK | 1350 | 297 |
| 9.4.2 | 425 | TYYRPGVNL | 200 | 298 |
| 9.4.3 | 652 | TYACFVSNL | 200 | 299 |
| 9.4.4 | 691 | IMIGVLVGV | 196 | 300 |
| 9.4.5 | 605 | YLSGANLNL | 98 | 301 |

Pos. is the residue position in the primary sequence of the first amino acid in the antigenic epitope. Sequence is the amino acid sequence of the predicted MHC Class I-presented epitope. Score is the $T_{1/2}$ of disassociation of a peptide containing this subsequence (Tsang KY. J Natl Cancer Inst. 1995 87:982-90). Peptide 9.3.1 are presented by HLA-A3. Peptides 9.3.2 and 9.3.2 are presented by HLA-A24. Peptides 9.3.4 and 9.3.5 are presented by HLA-A2.1. The MHC Class I-presented epitopes of this Table were predicted with the use of the online program (accessed via: bimas.dcrt.nih.gov/molbio/hla_bind/).

TABLE 9.5

Experimentally defined MHC Class I epitopes of CEA.

| PEPTIDE | Pos. | Sequence | SEQ ID NO: |
|---------|------|----------|------------|
| 9.5.1 | 691 | IMIGVLVGV | 302 |
| 9.5.2 | 24 | LMTFWNPPV | 303 |
| 9.5.3 | 605 | YLSGANLNL | 304 |
| 9.5.4 | 268 | QYSWFVNGTF | 305 |
| 9.5.5 | 652 | TYACFVSNL | 306 |
| 9.5.6 | 61 | HLFYSWYK | 307 |

Pos. is the residue position in the primary sequence of the first amino acid in the antigenic epitope. Sequence is the amino acid sequence of the experimentally defined MHC Class I-presented epitope. Peptides 9.5.1, 9.5.2, 9.5.3 are presented by HLA-A2.1 and 9.5.6 is presented by HLA-A3 (Kawashima I. Hum Immunol. 1998 59:1-14). Peptides 9.5.4 and 9.5.5 are presented by HLA-A24 (Nukaya I. Int J Cancer. 1999 80:92-7). Peptide 9.5.2 is presented by HLA-A2.1 and it and LLTFWNPPV (SEQ ID NO: 308) are engineered CEA epitopes with respect to the wild type sequence LLTFWNPPT (SEQ ID NO: 309).

TABLE 9.6

Ii-Key/MHC Class II/MHC Class I CEA hybrids.

| PEPTIDE | Pos. | Sequence | SEQ ID NO: |
|---------|------|----------|------------|
| 9.6.1 | II: 179, 357, 535, I: 691 | Ac-LRMK-ava-WVNNQSLPV-IMIGVL VGV-NH$_2$ | 310 |
| 9.6.2 | II: 427, I: 425 | Ac-LRMK-ava-TYYRPGVNLSL-NH$_2$ | 311 |
| 9.6.3 | II: 249, I: 268 | Ac-LRMK-ava-YRSGENLNL-QYSWF VNGTF-NH$_2$ | 312 |
| 9.6.4 | II: 52, I: 61 | Ac-LRMK-ava-LLLVHNLPQ-HLFYSW YK-NH$_2$ | 313 |

Ii-Key/MHC Class II/MHC Class I CEA hybrids. The sequence position of the MHC Class II epitope is indicated: II:residue position of first epitope amino acid, and of the MHC Class I epitope is indicated: I:residue position of first epitope amino acid.

Example 10

Ii-Key/Ca-125 Cancer Antigenic Epitope Hybrids

The ovarian cancer antigen CA-125 is used in immunotherapeutic vaccinations. In one case, vaccination with a mixed vaccine of autogeneic and allogeneic breast cancer cells and tumor associated antigens including the breast cancer antigen CA15.3, the carcinoembryonic antigen (CEA) and the ovarian cancer antigen CA125, resulted in immune and clinical responses in breast cancer patients (Jiang X P. Cancer Biother Radiopharm. 2000 15:495-505). The vaccine induced a significant increase in post-vaccination lymphocyte proliferative responses to AUTOC, CA15.3, CEA and CA125 but not ALLOC, compared to pre-vaccination ($p<0.05$, $p<0.01$, $p<0.05$, $p<0.01$ and $p>0.05$, respectively, a paired t Test).

The amino acid sequence of CA125 ovarian cancer antigen mucin 16 [Homo sa . . . [gi:14971110] as listed in Genebank is presented in Table 10.1. Predicted MHC Class II-presented epitopes of CA125, ovarian cancer antigen are listed in Table 10.2. Ii-Key/CA 125 hybrids containing some of the MHC Class II-presented epitopes of Table 10.2 are listed in Table 10.3. Predicted MHC Class I-presented epitopes of CA 125 are listed in Table 10.4. Ii-Key/MHC II epitope/MHC I epitope hybrids are listed in Table 10.5.

TABLE 10.1

Deduced amino acid sequence of CA125 ovarian cancer antigen (SEQ ID NO: 314)

| | | | | |
|---|---|---|---|---|
| 1 | rvdpigpgld | rerlywelsq | ltnsitelgp | ytldrdslyv | ngfnpwssvp |
| 51 | ttstpgtstv | hlatsgtpss | lpghtapvpl | lipftlnfti | tnlhyeenmq |
| 101 | hpgsrkfntt | ervlqgllkp | lfkstsvgpl | ysgcrltllr | pekhgaatgv |
| 151 | daictlrldp | tgpgldrerl | ywelsqltns | vtelgpytld | rdslyvngft |
| 201 | hrssvpttsi | pgtsavhlet | sgtpaslpgh | tapgpllvpf | tlnftitnlq |
| 251 | yeedmrhpgs | rkfnttervl | qgllkplfks | tsvgplysgc | rltllrpekr |
| 301 | gaatgvdtic | thrldplnpg | ldreqlywel | skltrgiiel | gpylldrgsl |
| 351 | yvngfthrnf | vpitstpgts | tvhlgtsetp | sslprpivpg | pllvpftlnf |
| 401 | titnlqyeea | mrhpgsrkfn | ttervlqgll | rplfkntsig | plysscrltl |

TABLE 10.1-continued

Deduced amino acid sequence of CA125 ovarian cancer antigen
(SEQ ID NO: 314)

```
 451 lrpekdkaat rvdaicthhp dpqspglnre qlywelsqlt hgitelgpyt
 501 ldrdslyvdg fthwspiptt stpgtsivnl gtsgippslp ettatgpllv
 551 pftlnftitn lqyeenmghp gsrkfnites vlqgllkplf kstsvgplys
 601 gcrltllrpe kdgvatrvda icthrpdpki pgldrqqlyw elsqlthsit
 651 elgpytldrd slyvngftqr ssvpttstpg tftvqpetse tpsslpgpta
 701 tgpvllpftl nftiinlqye edmhrpgsrk fnttervlqg llmplfknts
 751 vsslysgcrl tllrpekdga atrvdavcth rpdpkspgld rerlywklsq
 801 lthgitelgp ytldrhslyv ngfthqssmt ttrtpdtstm hlatsrtpas
 851 lsgpttaspl lvlftinfti tnlryeenmh hpgsrkfntt ervlqgllrp
 901 vfkntsvgpl ysgcrltllr pkkdgaatkv daictyrpdp kspgldreql
 951 ywelsqlths itelgpytld rdslyvngft qrssvpttsi pgtptvdlgt
1001 sgtpvskpgp saaspllvlf tlnftitnlr yeenmqhpgs rkfnttervl
1051 qgllrslfks tsvgplysgc rltllrpekd gtatgvdaic thhpdpkspr
1101 ldreqlywel sqlthnitel gpyaldndsl fvngfthrss vsttstpgtp
1151 tvylgasktp asifgpsaas hllilftlnf titnlryeen mwpgsrkfnt
1201 tervlqgllr plfkntsvgp lysgcrltll rpekdgeatg vdaicthrpd
1251 ptgpgldreq lylelsqlth sitelgpytl drdslyvngf thrssvptts
1301 tgvvseepft lnftinnlry madmgqpgsl kfnitdnvmq hllsplfqrs
1351 slgarytgcr vialrsvkng aetrvdllct ylqplsgpgl pikqvfhels
1401 qqthgitrlg pysldkdsly lngynepgpd eppttpkpat tflpplseat
1451 tamgyhlktl tlnftisnlq yspdmgkgsa tfnstegvlq hllrplfqks
1501 smgpfylgcq lislrpekdg aatgvdttct yhpdpvgpgl diqqlywels
1551 qlthgvtqlg fyvldrdslf ingyapqnls irgeyqinfh ivnwnlsnpd
1601 ptsseyitll rdiqdkvttl ykgsqlhdtf rfclvtnltm dsvlvtvkal
1651 fssnldpslv eqvfldktln asfhwlgsty qlvdihvtem essvyqptss
1701 sstqhfypnf titnlpysqd kaqpgttnyq rnkrniedal nqlfrnssik
1751 syfsdcqvst frsvpnrhht gvdslcnfsp larrvdrvai yeeflrmtrn
1801 gtqlqnftld rssvlvdgys pnrnepltgn sdlpfwavil iglagllgli
1851 tclicgvlvt trrrkkegey nvqqqcpgyy qshldledlq
```

TABLE 10.2

Predicted MHC Class II-presented epitopes of CA125, ovarian cancer antigen.

| PEPTIDE | Pos. | Sequence | Score | Ii-Key | SEQ ID NO: |
|---|---|---|---|---|---|
| 10.2.1 | 1630 | FRFCLVTNL | 7.40 | 9 | 315 |
| 10.2.2 | 1018 | VLFTLNFTI | 7.10 | — | 316 |
| 10.2.3 | 1174 | ILFTLNFTI | 7.10 | — | 317 |
| 10.2.4 | 156 | LRLDPTGPG | 6.80 | — | 318 |
| 10.2.5 | 1017 | LVLFTLNFT | 6.20 | — | 319 |
| 10.2.6 | 861 | LVLFTINFT | 6.05 | — | 320 |
| 10.2.7 | 527 | IVNLGTSGI | 5.70 | — | 321 |
| 10.2.8 | 1318 | LRYMADMGQ | 5.70 | — | 322 |
| 10.2.9 | 1029 | LRYEENMQH | 5.68 | — | 323 |

TABLE 10.2-continued

Predicted MHC Class II-presented epitopes of CA125, ovarian cancer antigen.

| PEPTIDE | Pos. | Sequence | Score | Ii-Key | SEQ ID NO: |
|---|---|---|---|---|---|
| 10.2.10 | 873 | LRYEENMHH | 5.68 | — | 324 |
| 10.2.11 | 1663 | VFLDKTLNA | 5.60 | 10 | 325 |
| 10.2.12 | 1172 | LLILFTLNF | 5.60 | — | 326 |
| 10.2.13 | 936 | YRPDPKSPG | 5.57 | 2 | 327 |
| 10.2.14 | 393 | LVPFTLNFT | 5.50 | 3 | 328 |
| 10.2.15 | 430 | LRPLFKNTS | 5.40 | — | 329 |
| 10.2.16 | 1185 | LRYEENMWP | 5.30 | 9 | 330 |
| 10.2.17 | 1634 | LVTNLTMDS | 5.30 | — | 331 |
| 10.2.18 | 360 | FVPITSTPG | 5.20 | 11 | 332 |
| 10.2.19 | 1209 | LRPLFKNTS | 5.10 | — | 333 |
| 10.2.20 | 898 | LRPVFKNTS | 5.10 | — | 334 |
| 10.2.21 | 1531 | YHPDPVGPG | 5.10 | — | 335 |

Pos. is the residue position in the primary sequence of the first amino acid in the antigenic epitope. Sequence is the amino acid sequence of the predicted MHC Class II-presented epitope. Score is the score reported by the ProPred program, for the relative likelihood of being presented by many common HLA-DR alleles. Ii-Key is the number of residue positions intervening between an Ii-Key motif and the first residue of the antigenic epitope. Because CA 125/MUC 16 is characterized by nine partially conserved tandem repeats (156 amino acids each) in an N-terminal region, similar predicted epitopes have different starting positions (e.g., start position 1017, 1173, 860, or 897, 1208, or 1184, 872, 1028).

TABLE 10.3

Ii-Key/CA125 hybrids containing some of the MHC Class II-presented epitopes of Table 10.2.

| PEPTIDE | Pos. | Sequence | SEQ ID NO: |
|---|---|---|---|
| Conserved tandem-repeats epitopes | | | |
| 10.3.1 | 1017 | Ac-LRMK-ava-VLFTLNFTI-NH$_2$ | 336 |
| 10.3.2 | 1173 | Ac-LRMK-ava-ILFTLNFTI-NH$_2$ | 337 |
| 10.3.3 | 860 | Ac-LRMK-ava-LVLFTINFT-NH$_2$ | 338 |
| 10.3.4 | 1028 | Ac-LRMK-ava-LRYEENMQH-NH$_2$ | 339 |
| 10.3.5 | 872 | Ac-LRMK-ava-LRYEENMHH-NH$_2$ | 340 |
| 10.3.6 | 1184 | Ac-LRMK-ava-LRYEENMWP-NH$_2$ | 341 |
| B. Overlapping MHC II epitopes | | | |
| 10.3.7 | 1629 | Ac-LRMK-ava-FRFCLVTNL-NH$_2$ | 342 |
| 10.3.8 | 1633 | Ac-LRMK-ava-LVTNLTMDS-NH$_2$ | 343 |
| 10.3.9 | 1629/1633 | Ac-LRMK-ava-FRFCLVTNLTMDS-NH$_2$ | 344 |

Pos. is the residue position in the primary sequence of the first amino acid in the antigenic epitope. Sequence is the amino acid sequence of a hybrid peptide containing a MHC Class II epitope of Table 10.2.

TABLE 10.4

Predicted MHC Class I-presented epitopes of CA 125.

| PEPTIDE | Pos. | Sequence | Score | SEQ ID NO: |
|---|---|---|---|---|
| 10.4.1 | 1675 | WLGSTYQLV | 478 | 345 |
| 10.4.2 | 1018 | VLFTLNFTI | 381 | 346 |
| 10.4.3 | 1174 | ILFTLNFTI | 381 | 347 |
| 10.4.4 | 862 | VLFTINFTI | 381 | 348 |
| 10.4.5 | 344 | LLDRGSLYV | 260 | 349 |
| 10.4.6 | 1506 | YLGCQLISL | 226 | 350 |
| 10.4.7 | 1668 | TLNASFHWL | 223 | 351 |
| 10.4.8 | 1555 | GVTQLGFYV | 194 | 352 |
| 10.4.9 | 1845 | GLLGLITCL | 182 | 353 |
| 10.4.10 | 32 | KLTRGIIEL | 172 | 354 |

Pos. is the residue position in the primary sequence of the first amino acid in the antigenic epitope. Sequence is the amino acid sequence of the predicted HLA-A2.1-resented epitope. Score is the $T_{1/2}$ of disassociation of a peptide containing this subsequence (Tsang K Y. J Natl Cancer Inst. 1995 87:982-90). The MHC Class I-presented epitopes of this Table were predicted with the use of the online program (accessed via: bimas.dcrt.nih.gov/molbio/hla_bind/).

TABLE 10.5

Ii-Key/MHC II epitope/MHC I epitope hybrids. Ii-Key/MHC Class

| PEPTIDE | Pos. | Sequence | SEQ ID NO: |
|---|---|---|---|
| 10.5.1 | 1630 | Ac-LRMK-ava-FRFCLVTNL-NH$_2$ | 355 |
| 10.5.2 | II: 392<br>I: 394, 238,<br>82, 550 | Ac-LRMK-ava-LVPFTLNFTI-NH$_2$ | 356 |

Ii-Key/MHC Class II/MHC Class I CEA hybrids. The sequence position of the MHC Class II epitope is indicated: II:residue position of first epitope amino acid, and of the MHC Class I epitope is indicated: I:residue position of first epitope amino acid. In peptide 10.5.1 the MHC Class II-predicted and the MHC Class I-predicted epitopes overlap precisely. In peptide 10.5.2 an MHC Class-predicted epitope starting at residue position 392 overlaps with the sequence of a MHC Class I-predicted epitope which starts (and is repeated at) residue positions 394, 238, 82, 550.

Example 11

Ii-Key/PSA Antigenic Epitope Hybrids

The identification of T cell specific epitopes within the coding sequence of PSA has led to the development of various vaccine strategies that target PSA in an attempt to treat established prostate cancer (Kaufman H L. Expert Opin Biol Ther. 2002 2:395-408). These strategies have included HLA-restricted PSA peptides, dendritic cells pulsed with PSA, recombinant viruses expressing PSA and combinations with different cytokines and cell interaction molecules. Many of these methods are enhanced by use of the products and methods of this disclosure.

PSA-recombinant pox vaccine constructs are immunogenic and induce antibody responses to a multitude of surface antigens on prostate tumor cell lines by epitope or determinant spreading after stimulation of the immune system by PSA immunization (Cavacini L A. Clin Cancer Res. 2002 8:368-73). Determinant spreading in the antibody responses to prostate cell surface antigens was observed in patients immunized with prostate-specific antigen encoded by recombinant pox vectors. The serum IgG response to cell surface antigens expressed on LNCAP (PSA-positive) and PC-3 (PSA-negative) prostate cancer cell lines were analyzed in individuals with advanced disease receiving vaccinia- or fowlpox-expressed PSA (v-PSA or f-PSA, respectively). Sera from all seven patients in a Phase I study of v-PSA, collected prior to the third immunization, reacted with both prostate tumor cell lines. The majority of individuals (n=12) in a Phase II trial of v-PSA and f-PSA developed sustainable antibody responses to cell surface antigens on the prostate tumor cell lines. The magnitude and kinetics of these responses depended on the immunization schedule.

Whiteside and colleagues demonstrated recovery of zeta-chain expression and changes in spontaneous IL-10 production after PSA-based vaccines in patients with prostate cancer (Meidenbauer N. Br J. Cancer. 2002 86:168-78). In order to determine a mechanism by which circulating T lymphocytes of patients with prostate cancer have been reported to have functional deficits, including low or absent zeta-chain expression, 10 patients treated with recombinant human prostate specific antigen plus GM-CSF and eight others receiving PSA plus oil emulsion were evaluated. Prior to therapy, the patients had significantly lower zeta-chain expression in circulating CD3+ cells and a higher percentage of zeta-chain negative CD3+ and CD4+ cells than normal donors. The patients' peripheral blood mononuclear cells spontaneously produced more IL-10 ex vivo than those of normal controls. After vaccination, recovery of zeta-chain expression was observed in 50% of patients in both clinical trials. Also, spontaneous IL-10 secretion by peripheral blood mononuclear cells decreased following immunotherapy in patients treated with PSA and GM-CSF. Such therapies will be greatly augmented by products and methods of this disclosure.

Mann and colleagues demonstrated enhanced CD4+ and CD8+ T cell responses after exposure to PSA alone, PSA targeted to the mannose receptor (mannosylated PSA (PSA-m)), or PSA targeted to Fc receptors by combining PSA with an anti-PSA antibody (AR47.47) (Berlyn K A. Clin Immunol. 2001 101:276-83). PSA and PSA-m are processed primarily through pathways that favor MHC Class II presentation, while the PSA/anti-PSA immune complexes are processed through both Class I and Class II pathways in monocyte-derived dendritic cells.

Gilboa and colleagues demonstrated that autologous dendritic cells transfected with PSA RNA stimulate CTL responses against metastatic prostate tumors (Heiser A. J Clin Invest. 2002 109:409-17). Autologous dendritic cells transfected with mRNA encoding prostate-specific antigen (PSA) stimulate potent, T cell-mediated antitumor immune responses in vitro. A phase I trial evaluated this strategy for safety, feasibility, and efficacy to induce T cell responses against the PSA in patients with metastatic prostate cancer. In 13 subjects, escalating doses of PSA mRNA-transfected dendritic cells were administered with no evidence of dose-limiting toxicity or adverse effects, including autoimmunity. Induction of PSA-specific T cell responses was consistently detected in all patients, suggesting in vivo bioactivity of the vaccine. Vaccination was further associated with a significant decrease in the log slope of serum PSA levels in six of seven subjects.

Schlom and colleagues characterized an agonist epitope designated PSA-3A ("A" for agonist) of the PSA-3 CTL epitope which demonstrated enhanced binding to the HLA-A2 allele and enhanced stability of the peptide-MHC complex (Terasawa H. Clin Cancer Res. 2002 8:41-53). T-cell lines generated with either the PSA-3 or the PSA-3A peptide showed higher levels of lysis of targets pulsed with the PSA-3A peptide than those targets pulsed with the PSA-3 peptide. T cells stimulated with dendritic cells (dendritic cells) pulsed with PSA-3A peptide produced higher levels of IFN-gamma than did dendritic cells pulsed with PSA-3 peptide. Dendritic cells infected with a recombinant vaccinia virus containing the agonist amino acid change within the entire PSA gene (designated rV-PSA-3A) were more effective than dendritic cells infected with the rV-PSA vector in enhancing IFN-gamma production by T cells. Finally, the PSA-3A agonist was shown to induce higher levels of T-cell activation, compared with the PSA-3 peptide, in an in vivo model using HLA-A2.1/K(b) transgenic mice. These studies thus demonstrated the potential use of the PSA-3A agonist epitope in both peptide- and vector-mediated immunotherapy protocols for prostate cancer. Such results can be bettered with the products and methods of this disclosure.

Recombinant PSA proteins incorporating 6×His (SEQ ID NO: 357) residues were synthesized for magnetic bead attachment allowing antigen isolation and delivery to APC for processing and presentation (Turner M J. J Immunol Meth. 1998 256:107-19). PSA deletion constructs were generated by amplifying 3' deletions of PSA using a constant 5' primer and five individual 3' primers starting at 736 bp, 610 bp, 505 bp, and 394 bp. The recombinant PSA proteins encoded 261, 231, 189, 154 and 117 amino acids. PSA-specific Class I- and II-restricted T cell hybridomas were generated by fusing Thy-1+tumor infiltrating lymphocytes (TIL) isolated from BALB/c mice challenged with Line 1/PSA/IL-2 tumors to the T cell fusion partner BWZ.36. MHC Class I (PSA 188-197) and Class II (PSA 238-253) T cell epitopes were identified.

The amino acid sequence of prostate specific antigen (PSA) as obtained from GenBank 45021731 kallikrein 3 is presented in Table 11.1. A cDNA vaccine for this antigen is available (Kim J J. Oncogene. 1998 17:3125-35). Predicted MHC Class II-presented epitopes of PSA are listed in Table 11.2. Experimentally defined MHC Class II-presented epitopes of PSA are listed in Table 11.3. Ii-Key/PSA hybrids containing some of the MHC Class II-presented epitopes of Tables 11.2 and 11.3 are listed in Table 11.4. Predicted MHC Class I-presented epitopes of PSA are listed in Table 11.5. Experimentally defined MHC Class I-presented epitopes of PSA are listed in Table 11.6. Ii-Key/PSA MHC II-presented epitope/PSA MHC I-presented epitope hybrids are listed in Table 11.7.

TABLE 11.1

(SEQ ID NO: 358)
Deduced amino acid sequence of PSA.

```
  1 mwvpvvfltl svtwigaapl ilsrivggwe cekhsqpwqv lvasrgravc
 51 ggvlvhpqwv ltaahcirnk svillgrhsl fhpedtgqvf qvshsfphpl
101 ydmsllknrf lrpgddsshd lmllrlsepa eltdavkvmd lptqepalgt
151 tcyasgwgsi epeefltpkk lqcvdlhvis ndvcaqvhpq kvtkfmlcag
201 rwtggkstcs gdsggplvcn gvlqgitswg sepcalperp slytkvvhyr
251 kwikdtivan p
```

TABLE 11.2

Predicted MHC Class II-presented epitopes of PSA.

| PEPTIDE | Pos. | Sequence | Score | Ii-Key | SEQ ID NO: |
|---------|------|----------|-------|--------|------------|
| 11.2.1  | 59   | WVLTAAHCI | 8.80 | —      | 359        |
| 11.2.2  | 2    | WVPVVFLTL | 8.10 | —      | 360        |
| 11.2.3  | 124  | LRLSEPAEL | 6.60 | —      | 361        |
| 11.2.4  | 67   | IRNKSVILL | 5.40 | 8      | 362        |
| 11.2.5  | 74   | LLGRHSLFH | 5.20 | —      | 363        |
| 11.2.6  | 72   | VILLGRHSL | 4.70 | —      | 364        |
| 11.2.7  | 223  | LQGITSWGS | 4.58 | —      | 365        |

Pos. is the residue position in the primary sequence of the first amino acid in the antigenic epitope. Sequence is the amino acid sequence of the predicted MHC Class II-presented epitope. Score is the score reported by the ProPred program, for the relative likelihood of being presented by many common HLA-DR alleles. Ii-Key is the number of residue positions intervening between an Ii-Key motif and the first residue of the antigenic epitope.

TABLE 11.3

Experimentally defined MHC Class II-presented epitopes of PSA.

| PEPTIDE | Pos. | Sequence | Ii-Key | SEQ ID NO: |
|---------|------|----------|--------|------------|
| 11.3.1  | 238  | ERPSLYTKVVHYRKWI | — | 366 |

Pos. is the residue position in the primary sequence of the first amino acid in the antigenic epitope. Sequence is the amino acid sequence of the experimentally defined MHC Class II-presented epitope. Ii-Key is the number of residue positions intervening between an Ii-Key motif and the first residue of the antigenic epitope. Peptide 11.3.1 was experimentally defined (Turner M J. J Immunol Meth. 2001 256:107-19).

TABLE 11.4

Ii-Key/PSA hybrids containing some of the MHC Class II-presented epitopes of Tables 11.2 and 11.3.

| PEPTIDE | Pos. | Sequence | SEQ ID NO: |
|---------|------|----------|------------|
| Non-overlapping epitopes ||||
| 11.4.1  | 2    | Ac-LRMK-ava-WVPVVFLTL-NH$_2$ | 367 |
| 11.4.2  | 124  | Ac-LRMK-ava-LRLSEPAEL-NH$_2$ | 368 |
| 11.4.3  | 223  | Ac-LRMK-ava-LQGITSWGS-NH$_2$ | 369 |
| B. Overlapping epitopes ||||
| 11.4.4  | 59   | Ac-LRMK-ava-WVLTAAHCI-NH$_2$ | 370 |
| 11.4.5  | 67   | Ac-LRMK-ava-IRNKSVILL-NH$_2$ | 371 |
| 11.4.6  | 72   | Ac-LRMK-ava-VILLGRHSL-NH$_2$ | 372 |
| 11.4.7  | 74   | Ac-LRMK-ava-LLGRHSLFH-NH$_2$ | 373 |
| 11.4.8  | 59, 67, 72, 74 | Ac-LRMK-ava-WVLTAAHCIR NKSVILLGRHSLFH-NH$_2$ | 374 |

Pos. is the residue position in the primary sequence of the first amino acid in the antigenic epitope. Sequence is the amino acid sequence of a hybrid peptide containing a MHC Class II epitope of Table 11.2 and 11.3. Peptide 11.4.8 contains several MHC Class II-presented epitopes each beginning at residue positions 59, 67, 72 and 74.

TABLE 11.5

Predicted MHC Class I-presented epitopes of PSA.

| PEPTIDE | Pos. | Sequence | Score | SEQ ID NO: |
|---------|------|----------|-------|------------|
| 11.5.1  | 46   | GRAVCGVL | 2000  | 375 |
| 11.5.2  | 67   | IRNKSVILL | 2000 | 376 |
| 11.5.3  | 124  | LRLSEPAEL | 2000 | 377 |
| 11.5.4  | 18   | APLILSRIV | 660  | 378 |
| 11.5.5  | 7    | FLTLSVTWI | 607  | 379 |
| 11.5.6  | 249  | YRKWIKDTI | 600  | 380 |

Pos. is the residue position in the primary sequence of the first amino acid in the antigenic epitope. Sequence is the amino acid sequence of the predicted MHC Class I-presented epitope. The MHC Class I-presented epitopes were predicted with the use of the online program (accessed via: bimas.dcrt.nih.gov/molbio/hla_bind/). Score is the $T_{1/2}$ of disassociation of a peptide containing this subsequence (Tsang K Y. J Natl Cancer Inst. 1995 87:982-90). Peptides 11.5.1, 11.5.2, 11.5.3 and 11.5.6 are presented optimally by HLA-B*2705. Peptide 11.5.4 is presented best by HLA-B*5102 and Peptide 11.5.5 is presented best by HLA-A*0201.

TABLE 11.6

Experimentally defined MHC Class I-presented epitopes of PSA.

| PEPTIDE | Pos. | Sequence | SEQ ID NO: |
|---|---|---|---|
| 11.6.1 | 188 | HPQKVTKFML | 381 |

Pos. is the residue position in the primary sequence of the first amino acid in the antigenic epitope. Sequence is the amino acid sequence of the experimentally defined MHC Class I-presented epitope.

TABLE 11.7

Ii-Key/PSA MHC II-presented epitope/PSA MHC I-presented epitope hybrids.
A Overlapping epitopes

| PEPTIDE | Pos. | Sequence | SEQ ID NO: |
|---|---|---|---|
| 11.7.1 | 2 | Ac-LRMK-ava-WVPVV FLTLSVTWI-NH$_2$ | 382 |
| 11.7.2 | 67 | Ac-LRMK-ava-IRNKSVI LL-NH$_2$ | 383 |
| 11.7.3 | 124 | Ac-LRMK-ava-LRLSEP AEL-NH$_2$ | 384 |

Pos. is the residue position in the primary sequence of the first amino acid in the antigenic epitope. Sequence is the amino acid sequence of a hybrid peptide containing a MHC Class II epitope of Table 11.2 and a MHC Class I epitope of Table 11.5. In each of the example the sequences of the predicted MHC Class II and MHC Class I peptides overlap precisely. The residue position of the first amino acid in the predicted MHC Class II epitopes are reported.

Example 12

Ii-Key/Melanocyte Protein Pmel 17 Antigenic Epitope Hybrids

Melanoma is a leading target in the development of therapeutic peptide and DNA vaccines because several specific tumor-associated antigens have been identified, efficiency of vaccinating mice with peptide or DNA vaccines in treating melanoma is proved, and use of comparable vaccines in the clinic has had occasionally promising results. The use of Ii-Key/melanoma antigenic epitope hybrids in melanoma vaccination is considered in respective Examples concerning melanocyte protein Pmel17, gp100, tyrosinase, and tyrosinase-s related protein.

Storkus and colleagues identified several MHC Class II-presented epitopes of gp 100/pmel17 and tyrosinase melanocyte-associated antigens and tested the response of tumor-reactive human CD4+ T cells from various melanoma patients against these peptides (Kierstead L S. Br J Cancer. 2001 85:1738-45). Two known and three novel CD4+ T cell epitopes were found using an IFN-gamma ELISPOT assay. Often freshly-isolated PBMC from HLA-DR4+ melanoma patients that are currently disease-free reveal elevated Th1-type CD4+ T-cells that recognize these peptides. Ii-Key/antigenic epitope hybrids incorporating these epitopes are presented in this Disclosure.

One problem in tumor immunotherapy is the fact that hosts can be tolerized to self proteins of the tumor. Intracutaneous immunization of C57BL/6 mice with a human Pmel17/gp100 DNA vaccine, but not the murine DNA, induces T cell-mediated B16 melanoma protection in vivo (Wagner S N. J Invest Dermatol. 2000 115:1082-7). This state of unresponsiveness to the autoantigen Pmel17/gp100 was broken by immunization with a plasmid DNA construct encoding the autologous form of the molecule. Mice receiving of Pmel17/gp100 DNA mounted an antigen-specific cytotoxic T lymphocyte response to M3 melanoma. Furthermore M3 tumors growing in immunized mice lost expression of this melanoma-associated antigen whereas M3 melanomas appearing in control-vector-treated animals were still Pmel17/gp100-positive. Ii-Key/antigenic epitope hybrids with appropriate immunization schemes and adjuvants can preferentially induce a Th1 or Th2 pattern of response thereby breaking tolerance.

The amino acid sequence of melanocyte protein Pmel 17 was obtained at NCBI, >gi|1125063|gb|AAB00386.1| melanocyte protein Pmel 17 [Homo sapiens] =>gi|639590|gb|AAC60634.1| gp100 [Homo sapiens].

TABLE 12.1

Deduced amino acid sequence of gp 100/pmel.
(SEQ ID NO: 385)

```
  1 mdlvlkrcll hlavigalla vgatkvprnq dwlgvsrqlr
    tkawnrqlyp 51 ewteaqrldc wrggqvslkv sndgptliga nasfsialnf
    pgsqkvlpdg 101 viwvnntii ngsqvwggqp vypqetddac ifpdggpcps
    gswsqkrsfv 151 yvwktwgqyw qvlggpvsgl sigtgramlg thtmevtvyh
    rrgsrsyvpl 201 ahsssaftit dqvpfsvsvs qlraldggnk hflrnqpltf
    alqlhdpsgy 251 laeadlsytw dfgdssgtli sralvvthty lepgpvtaqv
    vlqaaiplts 301 cgsspvpgtt dghrptaeap nttagqvptt evvgttpgqa
    ptaepsgtts 351 vqvpttevis tapvqmptae stgmtpekvp vsevmgttla
    emstpeatgm 401 tpaevsivvl sgttaaqvtt tewvettare lpipepegpd
    assimstesi 451 tgslgplldg tatlrlvkrq vpldcvlyry gsfsvtldiv
    qgiesaeilq 501 avpsgegdaf eltvscqggl pkeacmeiss pgcqppaqrl
    cqpvlspac 551 qlvlhqilkg gsgtyclnvs ladtnslavv stqlimpgqe
    aglgqvpliv
```

TABLE 12.1-continued

Deduced amino acid sequence of gp 100/pmel.
(SEQ ID NO: 385)

601 gillvlmavv lasliyrrrl mkqdfsvpql phssshwlrl
    prifcscpig 651 enspllsgqq v

TABLE 12.2

Predicted MHC Class II-presented epitopes of gp 100.

| PEPTIDE | Pos. | Sequence | Score | Ii-Key | SEQ ID NO: |
|---|---|---|---|---|---|
| 12.2.1 | 150 | VYVWKTWGQ | 6.80 | — | 386 |
| 12.2.2 | 423 | WVETTREL | 6.40 | — | 387 |
| 12.2.3 | 477 | LYRYGSFSV | 6.40 | 3 | 388 |
| 12.2.4 | 290 | VVLQAAIPL | 6.40 | 10 | 389 |
| 12.2.5 | 552 | LVLHQILKG | 6.10 | — | 390 |
| 12.2.6 | 596 | VPLIVGILL | 5.80 | — | 391 |
| 12.2.7 | 600 | VGILLVLMA | 5.80 | — | 392 |
| 12.2.8 | 605 | VLMAVVLAS | 5.80 | — | 393 |
| 12.2.9 | 604 | LVLMAVVLA | 5.70 | — | 394 |
| 12.2.10 | 3 | LVLKRCLLH | 5.40-7.20 | — | 395 |
| 12.2.11 | 615 | IYRRRLMKQ | 5.10-5.70 | — | 396 |
| 12.2.12 | 616 | YRRRLMKQD | 4.50 | — | 397 |
| 12.2.13 | 48 | LYPEWTEAQ | 4.30 | 8 | 398 |

Pos. is the residue position in the primary sequence of the first amino acid in the antigenic epitope. Sequence is the amino acid sequence of the predicted MHC Class II-presented epitope. Score is the score reported by the ProPred program, for the relative likelihood of being presented by many common HLA-DR alleles. Ii-Key is the number of residue positions intervening between an Ii-Key motif and the first residue of the antigenic epitope.

TABLE 12.3

Experimentally defined MHC Class II-presented epitopes of gp100.

| PEPTIDE | Pos. | Sequence | Ii-Key | SEQ ID NO: |
|---|---|---|---|---|
| 12.3.1 | 44 | WNRQLYPEWTEAQRLD | 4 | 399 |
| 12.3.2 | 615 | IYRRRLMKQDFSVPQLPHS | — | 400 |
| 12.3.3 | 576 | SLAVVSTQLIMPG | — | 401 |
| 12.3.4 | 175 | GRAMLGTHTMEVTVY | — | 402 |
| 12.3.5 | 74 | GPTLIGANASFSIALN | — | 403 |

Pos. is the residue position in the primary sequence of the first amino acid in the antigenic epitope. Sequence is the amino acid sequence of the experimentally defined MHC Class II-presented epitope. Score is the score reported by the ProPred program, for the relative likelihood of being presented by many common HLA-DR alleles. Ii-Key is the number of residue positions intervening between an Ii-Key motif and the first residue of the antigenic epitope. DR*0401 best presented peptide 12.3.1 (Storkus W. Forum (Genova). 2000 10:256-70) and peptide 12.3.2 (Kierstead L. Brit J Cancer. 2001 85:1738-45). The remaining peptides of this Table were identified by Kobayashi H. (Cancer Res. 2001 61:7577-84).

TABLE 12.4

Ii-Key/gp 100 hybrids containing some of the MHC Class II-presented epitopes of Table 12.2 and 12.3.

| PEPTIDE | Pos. | Sequence | SEQ ID NO: |
|---|---|---|---|
| Non-overlapping epitopes ||||
| 12.4.1 | 615 | Ac-LRMK-ava-IYRRRLMKQDFSVPQLPHS-NH$_2$ | 404 |
| 12.4.2 | 3 | Ac-LRMK-ava-LVLKRCLLH-NH$_2$ | 405 |
| 12.4.3 | 150 | Ac-LRMK-ava-VYVWKTWGQ-NH$_2$ | 406 |
| 12.4.5 | 423 | Ac-LRMK-ava-WVETTAREL-NH$_2$ | 407 |
| 12.4.6 | 477 | Ac-LRMK-ava-LYRYGSFSV-NH$_2$ | 408 |
| B. Overlapping epitopes ||||
| 12.4.7 | 44 | Ac-LRMK-ava-WNRQLYPEWTEAQRLD-NH$_2$ | 409 |
| 12.4.8 | 48 | Ac-LRMK-ava-LYPEWTEAQ-NH$_2$ | 410 |
| 12.4.9 | 44, 48 | Ac-LRMK-ava-WNRQLYPEWTEAQRLD-NH$_2$ | 411 |
| 12.4.10 | 596 | Ac-LRMK-ava-VPLIVGILL-NH$_2$ | 412 |
| 12.4.11 | 600 | Ac-LRMK-ava-VGILLVLMA-NH$_2$ | 413 |

TABLE 12.4-continued

Ii-Key/gp 100 hybrids containing some of the MHC Class II-presented epitopes of Table 12.2 and 12.3.

| PEPTIDE | Pos. | Sequence | SEQ ID NO: |
|---|---|---|---|
| 12.4.12 | 605 | Ac-LRMK-ava-VLMAVVLAS-NH$_2$ | 414 |
| 12.4.13 | 596, 600, 605 | Ac-LRMK-ava-VPLIVGILLVLMAVVLAS-NH$_2$ | 415 |

Pos. is the residue position in the primary sequence of the first amino acid in the antigenic epitope. Sequence is the amino acid sequence of a hybrid peptide containing a MHC Class II epitope of Table 1.2.

TABLE 12.5

Predicted MHC Class I-presented epitopes of gp 100.

| PEPTIDE | Pos. | Sequence | Score | SEQ ID NO: |
|---|---|---|---|---|
| 12.5.1 | 619 | RLMKQDFSV | 1495 | 416 |
| 12.5.2 | 520 | LPKEACMEI | 629 | 417 |
| 12.5.3 | 602 | ILLVLMAVV | 412 | 418 |
| 12.5.4 | 479 | RYGSFSVTL | 400 | 419 |
| 12.5.5 | 154 | KTWGQYWQV | 315 | 420 |
| 12.5.6 | 17 | ALLAVGATK | 45 | 421 |
| 12.5.7 | 614 | LIYRRRLMK | 20 | 422 |

Pos. is the residue position in the primary sequence of the first amino acid in the antigenic epitope. Sequence is the amino acid sequence of the predicted MHC Class I-presented epitope. The MHC Class I-presented epitopes were predicted with the use of the online program (accessed via: bimas.dcrt.nih.gov/molbio/hla_bind/). Score is the $T_{1/2}$ of disassociation of a peptide containing this subsequence (Tsang K Y. J Natl Cancer Inst. 1995 87:982-90). Peptides 12.5.1, 12.5.3 and 12.5.5 are presented by HLA-A*0201. Peptide 12.5.2 is presented by HLA-B*5101. Peptides 12.5.4 is presented by HLA-A*24. Peptides 12.5.6 and 12.5.7 are presented by HLA-A3.

TABLE 12.6

Experimentally defined MHC Class I-presented epitopes of gp100.

| PEPTIDE | Pos. | Sequence | SEQ ID NO: |
|---|---|---|---|
| 12.6.1 | 280 | YLEPGPVTA | 423 |
| 12.6.2 | 17 | ALLAVGATK | 424 |
| 12.6.3 | 209 | ITDQVPFSV | 425 |
| 12.6.4 | 614 | LIYRRRLMK | 426 |
| 12.6.5 | 619 | RLMKQDFSV | 427 |
| 12.6.6 | 639 | RLPRIFCSC | 428 |
| 12.6.7 | 154 | KTWGQYWQV | 429 |
| 12.6.8 | 177 | AMLGTHTMEV | 430 |
| 12.6.9 | 570 | SLADTNSLAV | 431 |
| 12.6.10 | 70 | VSNDGPTLI | 432 |
| 12.6.11 | 87 | ALNFPGSQK | 433 |

Pos. is the residue position in the primary sequence of the first amino acid in the antigenic epitope. Sequence is the amino acid sequence of the predicted MHC Class I-presented epitope. Peptide 12.6.1 is presented by HLA-A2 (Slingluff C. Clin Cancer Res. 2001 7:3012-24). Peptide 12.6.2 is presented by HLA-A3 (Yamshchikov G. Int J Cancer. 2001 92:703-11). Peptides 12.6.3, 12.6.5, 12.6.6 and 12.6.7 are presented by HLA-A*02012 (Kawakami Y. Proc Natl Acad Sci USA 1998). Peptide 12.6.8 and 12.6.9 are presented by HLA-A*0201 (Tsai V. J Immunol. 1997 158:1796-802). Peptide 12.6.10 is presented by HLA-Cw8 (Castelli C. J Immunol. 1999 162:1739-48). Peptide 12.6.11 is presented by HLA-A3 and HLA-A11.

TABLE 12.7

Designed Ii-Key/gp 100 hybrids containing some of the MHC Class I- and Class II-presented epitopes of Tables 4 and 5.

| PEPTIDE | Pos. | Sequence | SEQ ID NO: |
|---|---|---|---|
| Non-overlapping epitopes ||||
| 12.7.1 | II: 520, I: 552 | Ac-LRMK-ava-LPKEACMEI-LVLHQILKG-NH$_2$ | 434 |
| 12.7.2 | II: 17, I: 3 | Ac-LRMK-ava-ALLAVGATK-LVLKRCLLH-NH$_2$ | 435 |
| B. Overlapping epitopes ||||
| 12.7.3 | II: 570, I: 576 | Ac-LRMK-ava-SLADTNSLAVVSTQLIMPG-NH$_2$ | 436 |

TABLE 12.7-continued

Designed Ii-Key/gp 100 hybrids containing some of the
MHC Class I- and Class II-presented epitopes of Tables 4 and 5.

| PEPTIDE | Pos. | Sequence | SEQ ID NO: |
|---|---|---|---|
| 12.7.4 | II: 177, I: 175 | Ac-LRMK-ava-GRAMLGTHTMEVTVY-NH$_2$ | 437 |
| 12.7.5 | II: 70, II87, I: 74 | Ac-LRMK-ava-VSNDGPTLIGANASFSIALNFPGSQK-NH$_2$ | 438 |
| 12.7.6 | II: 614 (619), I: 615 | Ac-LRMK-ava-LIYRRRLMKQDFSVPQLPHS-NH$_2$ | 439 |
| 12.7.7 | II: 154, I: 150 | Ac-LRMK-ava-VYVKTWGQYWQV-NH$_2$ | 440 |
| 12.7.8 | II: 479, I: 477 | Ac-LRMK-ava-LYRYGSFSVTL-NH$_2$ | 441 |

Pos. is the residue position in the primary sequence of the first amino acid in the antigenic epitope, with MHC Class II indicated as I:, and MHC Class II indicated as II: Sequence is the amino acid sequence of a hybrid peptide containing a MHC Class II epitope of Table 1.2. Peptides 12.7.3, 12.7.4 and 12.7.5 have been already proposed (Kabayashi H. Cancer Res. 2001 61:7577-84). Peptide 12.7.6-amino acid sequence of both MHC Class I- and II-presented gp 100 epitopes are experimentally defined and coincide.

Example 13

Ii-Key/Tyrosinase-Related Protein 2 Antigenic Epitope Hybrids

The amino acid sequence of tyrosinase-related protein 2 as given in GenBank gi|731026|sp|P40126|TYR2_HUMAN Dopachrome tautomerase precursor (DT) (DCT) (Dopachrome delta-isomerase) (Tyrosinase-related protein 2) (TRP-2) (TRP2) is presented in Table 13.1. Predicted MHC Class II-presented epitopes of TRP-2 are listed in Table 13.2. Designed Ii-Key/TRP-2 antigenic epitope hybrids containing some of the MHC Class II-presented epitopes of Table 13.2 are listed in Table 13.3. Predicted MHC Class-I presented epitopes of TRP-2 are listed in Table 13.4. Experimentally defined MHC Class I-presented TRP-2 epitopes are listed in Table 13.5. Designed Ii-Key/TRP-2 hybrids containing some of the MHC Class I- and II-presented epitopes of Tables 13.2, 13.3, 13.4 and 13.5 are listed in Table 13.6.

TABLE 13.1

Deduced amino acid sequence of
melanocyte protein Pmel 17.
(SEQ ID NO: 442)

```
  1 msplwwgfll sclgckilpg aqgqfprvcm tvdslvnkec
    cprlgaesan 51 vcgsqqgrgq ctevradtrp wsgpyilrnq ddrelwprkf
    fhrtckctgn 101 fagyncgdck fgwtgpncer kkppvirqni hslspqereq
    flgaldlakk 151 rvhpdyvitt qhwlgllgpn gtqpqfancs vydffvwlhy
    ysvrdtllgp 201 grpyraidfs hqgpafvtwh ryhllclerd lqrlignesf
    alpywnfatg
```

TABLE 13.1-continued

Deduced amino acid sequence of
melanocyte protein Pmel 17.
(SEQ ID NO: 442)

```
251 rnecdvctdq lfgaarpddp tlisrnsrfs swetvcdsld
    dynhlvtlcn 301 gtyegllrrn qmgrnsmklp tlkdirdcls lqkfdnppff
    qnstfsfrna 351 legfdkadgt ldsqvmslhn lvhsflngtn alphsaandp
    ifvvlhsftd 401 aifdewmkrf nppadawpqe lapighnrmy nmvpffppvt
    neelfltsdq 451 lgysyaidlp vsveetpgwp ttllvvmgtl valvglfvll
    aflqyrrlrk 501 gytplmethl sskryteea
```

TABLE 13.2

Predicted MHC Class II-presented
epitopes of TRP-2.

| PEPTIDE | Pos. | Sequence | Score | Ii-Key | SEQ ID NO: |
|---|---|---|---|---|---|
| 13.2.1 | 156 | YVITTQHWL | 8.20 | 9 | 443 |
| 13.2.2 | 451 | LGYSYAIDL | 7.60 | — | 444 |
| 13.2.3 | 64 | VRADTRPWSG | 6.60 | — | 445 |
| 13.2.4 | 483 | LVGLFVLLA | 6.10 | — | 446 |
| 13.2.5 | 272 | LISRNSRFS | 5.70 | — | 447 |
| 13.2.6 | 392 | FVVLHSFTD | 5.50 | — | 448 |
| 13.2.7 | 219 | WHRYHLLCL | 5.40 | 7 | 449 |
| 13.2.8 | 498 | LRKGYTPLM | 5.30 | — | 450 |
| 13.2.9 | 365 | VMSLHNLVH | 5.20 | — | 451 |
| 13.2.10 | 474 | LVVMGTLVA | 5.10 | — | 452 |

Pos. is the residue position in the primary sequence of the first amino acid in the antigenic epitope. Sequence is the amino acid sequence of the predicted MHC Class II-presented epitope. Score is the score reported by the ProPred program, for the relative likelihood of being presented by many common HLA-DR alleles. Ii-Key is the number of residue positions intervening between an Ii-Key motif and the first residue of the antigenic epitope.

TABLE 13.3

Designed Ii-Key/TRP-2 antigenic epitope hybrids containing some of the MHC Class II-presented epitopes of Table 13.2.

| PEPTIDE | Pos. | Sequence | Score | SEQ ID NO: |
|---|---|---|---|---|
| 13.3.11 | 156 | Ac-LRMK-ava-YVITTQHWL-NH$_2$ | | 453 |
| 13.3.12 | 451 | Ac-LRMK-ava-LGYSYAIDL-NH$_2$ | | 454 |
| 13.3.13 | 64 | Ac-LRMK-ava-VRADTRPSG-NH$_2$ | | 455 |

Pos. is the residue position in the primary sequence of the first amino acid in the antigenic epitope. Sequence is the amino acid sequence of a hybrid peptide containing a MHC Class II epitope of Table 13.2.

TABLE 13.4

Predicted MHC Class-I presented epitopes of TRP-2.

| PEPTIDE | Pos. | Sequence | Score | SEQ ID NO: |
|---|---|---|---|---|
| 13.4.1 | 277 | SRFSSWETV | 3000 | 456 |
| 13.4.2 | 408 | KRFNPPADA | 3000 | 457 |
| 13.4.3 | 325 | IRDCLSLQK | 2000 | 458 |
| 13.4.4 | 150 | KRVHPDYVI | 1800 | 459 |
| 13.4.5 | 427 | NRMYNMVPF | 1000 | 460 |
| 13.4.6 | 485 | GLFVLLAFL | 999 | 461 |
| 13.4.7 | 180 | SVYDFFVWL | 973 | 462 |
| 13.4.8 | 490 | LAFLQYRRL | 665 | 463 |
| 13.4.9 | 431 | NMVPFFPPV | 363 | 464 |
| 13.4.10 | 185 | FVWLHYYSV | 348 | 465 |
| 13.4.11 | 180 | SVYDFFVWL | 504 | 466 |
| 13.4.12 | 199 | GPGRPYRAI | 440 | 467 |
| 13.4.13 | 264 | AARPDDPTL | 360 | 468 |
| 13.4.14 | 353 | GFDKADGTL | 330 | 469 |
| 13.4.15 | 408 | KRFNPPADA | 300 | 470 |
| 13.4.16 | 189 | HYYSVRDTL | 280 | 471 |
| 13.4.17 | 331 | LQKFDNPPF | 240 | 472 |

Pos. is the residue position in the primary sequence of the first amino acid in the antigenic epitope. Sequence is the amino acid sequence of the predicted MHC Class II-presented epitope. The MHC Class I-presented epitopes of Table 9.4 were predicted with the use of the online program (accessed via: bimas.dcrt.nih.gov/molbio/hla_bind/). Score is the $T_{1/2}$ of disassociation of a peptide containing this subsequence (Tsang K Y. J Natl Cancer Inst. 1995 87:982-90). Peptides 13.4.1, 13.4.2, 13.4.3, 13.4.4 and 13.4.5 are presented by HLA-B*2705. Peptides 13.4.6, 13.4.7, 13.4.9 and 13.4.10 are presented by HLA-A*0201. Peptides 13.4.8 is presented by HLA-B*5102. Peptide 13.4.11 is presented by HLA-A*0205. Peptides 13.4.12 is presented by HLA-B5101 and HLA-B*5102. Peptide 13.4.13 is presented by HLA-B7. Peptides 13.4.14 is presented by Cw*0401. Peptide 13.4.15 is presented by HLA-B*2702. Peptide 13.4.16 is presented by HLA-A24. Peptide 13.4.17 is presented by HLA-B62.

TABLE 13.5

Experimentally defined MHC Class I-presented TRP-2 epitopes.

| PEPTIDE | Pos. | Sequence | SEQ ID NO: |
|---|---|---|---|
| 13.5.1 | 180 | SVYDFFVWL | 473 |
| 13.5.2 | 360 | TLDSQVMSL | 474 |
| 13.5.3 | 288 | SLDDYNHLV | 475 |
| 13.5.4 | 455 | YAIDLPVSV | 476 |

Pos. is the residue position in the primary sequence of the first amino acid in the antigenic epitope. Sequence is the amino acid sequence of the experimentally defined MHC Class I-presented epitope. Peptide 13.5.1 is presented by HLA-A2 (Parkhurst M R. Cancer Res. 1998 58:4895-901). Peptides 13.5.2 and 13.5.3 are presented by HLA-A2.1 (Noppen C. Int J Cancer. 2000 87:241-6). Peptide 13.5.4 is presented by HLA-A2.1 (Harada M. Cancer Res. 2001 61:1089-94).

TABLE 13.6

Designed Ii-Key/TRP-2 hybrids containing some of the MHC Class I and II-presented epitopes of Tables 13.2, 13.3, 13.4 and 13.5.

| PEPTIDE | Pos. | Sequence | SEQ ID NO: |
|---|---|---|---|
| 13.6.1 | I: 180; II: 156 | Ac-LRMK-ava-YVITTQHWL-SVYDFFVWL-NH$_2$ | 477 |
| 13.6.2 | I: 455; II: 451 | Ac-LRMK-ava-LGYSYAIDLPVSV-NH$_2$ | 478 |
| 13.6.3 | I: 360; II: 365 | Ac-LRMK-ava-TLDSQVMSLHNLVH-NH$_2$ | 479 |

Pos. is the residue position in the primary sequence of the first amino acid in the antigenic epitope. Sequence is the amino acid sequence of a hybrid peptide containing a MHC Class II epitope of Table 13.2 and a MHC Class I epitope of Table 13.4.

Example 14

Ii-Key/Melanoma Tyrosinase Antigenic Epitope Hybrids

Tyrosinase has many advantages as a target antigen for the immunotherapy of patients with melanoma because it is expressed in nearly all melanoma specimens with a high degree of cellular homogeneity, and its distribution in normal tissues is limited to melanocytes. Several MHC Class I-presented epitopes have been identified and used clinically, and MHC Class II-presented epitopes have been discovered. The following summaries of the current state-of-the-art in identification and use of peptide vaccines, DNA vaccines, and dendritic cell charging with peptide preparations (tumor cell lysates) are presented in part to illustrate the value of the products and methods of this Disclosure to improving these procedures.

Rosenberg and colleagues identified a HLA-A2.1-presented restricted melanoma tyrosinase epitope (tyrosinase8-17; CLLWSFQTSA) (SEQ ID NO: 480) (Riley J P. J Immunother. 2001 24:212-20). In this study, the comparative binding to HLA-A2.1 of a series of algorithm-predicted peptides versus that of a standard peptide with an intermediate binding affinity was determined. Twelve peptides with binding affinities within 80% of that of the standard peptide stimulated peripheral blood mononuclear cells (PBMC) in vitro from three HLA-A2.1+ patients with metastatic melanoma. PBMC from 23 HLA-A2.1+ patients were stimulated in vitro with tyrosinase:8-17. Eleven bulk T-cell cultures demonstrated specific peptide recognition, and six of these also recognized HLA-A2.1+ tyrosinase+melanoma cells. This epitope can be incorporated in an Ii-Key/MHC Class II-presented epitope/MHC Class I-presented epitope hybrid.

Weber and colleagues found that patients with resected melanoma mounted an immune response against gp100(209-217)(210M) (IMDQVPSFV) (SEQ ID NO: 481) and tyrosinase(368-376)(370D) (YMDGTMSQV) (SEQ ID NO: 482), emulsified with incomplete Freund's adjuvant (Lee P. J Clin Oncol. 2001 19:3836-47). Patients received peptides/IFA with or without IL-12 (30 ng/kg) to evaluate the toxicities and immune responses. Immunizations were administered every 2 weeks for 8 weeks, then every 4 weeks for 12 weeks, and then once 8 weeks later. Thirty-four of 40 patients developed a positive skin test response to the gp100 peptide but none responded to the tyrosinase peptide. Immune responses were measured by release of gamma-interferon in an enzyme-linked immunosorbent assay (ELISA) by effector cells in the presence of peptide-pulsed antigen-presenting cells or by an antigen-specific tetramer flow cytometry assay. Thirty-three of 38 patients demonstrated an immune response by ELISA after vaccination, as did 37 of 42 patients by tetramer assay. Twenty-four of 48 patients relapsed with a median follow-up of 20 months, and 10 patients in this high-risk group have died.

Slingluff and colleagues evaluated peptide vaccine immunogenicity of several peptides restricted to different HLA-A alleles in draining lymph nodes and peripheral blood of melanoma patients because vaccine trials have been limited mostly to those associated with HLA-A2, and immune responses have been detected inconsistently (Yamshchikov G V. Int J Cancer. 2001 92:703-11). They vaccinated stage IV melanoma patients with a mixture of gp100 and tyrosinase peptides restricted by HLA-A1 (DAEKSDICTDEY) (SEQ ID NO: 483), HLA-A2 (YLEPGPVTA (SEQ ID NO: 484) and YMDGTMSQV (SEQ ID NO: 485)) and HLA-A3 (ALLAVGATK) (SEQ ID NO: 486) in an emulsion with GM-CSF and Montanide ISA-51 adjuvant. CTL responses to vaccinating peptides were found in a lymph node draining a vaccine site (sentinel immunized node, SIN) in 5/5 patients (100%) in PBLs of 2/5 patients (40%). Peptides restricted by HLA-A1 and -A3 and HLA-A2 restricted peptide, YMDGTMSQV (SEQ ID NO: 485), were immunogenic.

Cytotoxic T lymphocytes against melanoma-associated antigens were induced by a recombinant vaccinia virus vector expressing multiple immunodominant epitopes and costimulatory molecules in vivo (Oertli D. Hum Gene Ther. 2002 13:569-75). Patients received psoralen-UV-treated and replication-incompetent recombinant vaccinia virus encoding the three immunodominant HLA-A*0201-restricted epitopes Melan-A(27-35), gp100(280-288), and tyrosinase(1-9) together with two costimulatory molecules, B7.1 and B7.2, in the context of systemic granulocyte-macrophage colony-stimulating factor (GM-CSF) treatment. Subsequent boosts used corresponding synthetic nona-peptides and GM-CSF. Within 12 days of injection of the recombinant vector, cytotoxic T cell responses specific for engineered epitopes were detected in three of three patients. During the vaccination treatment, antigen-specific CTL frequencies exceeding 1:10,000 peripheral CD8+ T cells could be observed.

Two stage IV melanoma patients vaccinated with an HLA-A2- or HLA-A24-restricted tyrosinase peptide, and GM-CSF had long-term freedom from recurrence (Scheibenbogen C. Int J Cancer. 2002 99:403-8). While the patients had experienced 9 and 12 relapses (mostly subcutaneous), respectively, during the 3 years before vaccination, they experienced freedom from relapse for more than 2 years after vaccination. T-cell responses to the vaccine peptide were found in the peripheral blood of both patients using an IFN-gamma ELISPOT assay.

Mule and colleagues found that addition of keyhole limpet hemocyanin (KLH) augmented the efficacy of both tumor lysate-pulsed dendritic cells and peptide-pulsed dendritic cells immunizations for immune priming and rejection of established metastases of the D5 subline of B16 melanoma in vivo (Shimizu K. Cancer Res. 2001 61:2618-24). Interleukin 2 further augmented the enhancement afforded by KLH, as measured by cure rates and overall survival, in the absence of autoimmune depigmentation. KLH added to dendritic cells immunizations markedly enhances tumor-specific T cell production of IFN-gamma. D5 melanoma exposed to similar levels of IFN-gamma results in substantial expression of MHC Class I molecules. Immunization with dendritic cells pulsed with KLH and mouse tyrosinase-related protein-2 peptide results in enhanced reduction of B16 melanoma metastases; the effect is most pronounced in a setting where tyrosinase-related protein-2 peptide-pulsed dendritic cells alone are completely ineffective.

Therapeutic efficacy of a tumor cell-based vaccine against B16 melanoma requires disruption of either of two immunoregulatory mechanisms that control autoreactive T cell responses: the cytotoxic T lymphocyte-associated antigen (CTLA)-4 pathway or the CD25+ regulatory T cells. Combination of CTLA-4 blockade and depletion of CD25+ T cells results in maximal tumor rejection (Sutmuller R P. J Exp Med. 2001 194:823-32). Efficacy of the antitumor therapy correlates with the extent of autoimmune skin depigmentation as well as with the frequency of tyrosinase-related protein 2(180-188)-specific CTLs detected in the periphery. Furthermore, tumor rejection is dependent on the CD8+ T cell subset. The CTL response against melanoma antigens is an important component of the therapeutic antitumor response, and the reactivity of these CTLs can be augmented through interference with immunoregulatory mechanisms. The synergism in the effects of CTLA-4 blockade and depletion of CD25+ T cells indicates that CD25+ T cells and CTLA-4 signaling represent two alternative pathways for suppression of autoreactive T cell immunity. Simultaneous intervention with both regulatory mechanisms is, therefore, a promising concept for the induction of therapeutic antitumor immunity.

The amino acid sequence of tyrosinase as given in GenBank 4507753|ref|NP_000363.1| tyrosinase (oculocutaneous albinism IA); Tyrosinase [*Homo sapiens*] is listed in Table 14.1. Predicted MHC Class II-presented epitopes of tyrosinase are listed in Table 14.2. Experimentally defined MHC Class II-presented epitopes of tyrosinase are listed in Table 14.3. Designed Ii-Key/tyrosinase hybrids containing some of the MHC Class II-presented epitopes of Table 14.2 and 14.3 are listed in Table 14.4. Predicted MHC Class I-presented epitopes of tyrosinase are listed in Table 14.5. The experimental identification of MHC Class I-presented epitopes of tyrosinase (Pos. 240, 368, 146) is described in the gp100 example. Experimentally defined MHC Class I-presented epitopes of tyrosinase are listed in Table 14.6. Designed Ii-Key/tyrosinase hybrids containing some of the MHC Class I- and MHC Class II-presented epitopes of Tables 14.2, 14.3, 14.4 and 14.5 are listed in Table 14.7.

TABLE 14.1

(SEQ ID NO: 487)
Deduced amino acid sequence of tyrosinase.

```
  1 mllavlycll wsfqtsaghf pracvssknl mekeccppws gdrspcgqls
 51 grgscqnill snaplgpqfp ftgvddresw psvfynrtcq csgnfmgfnc
101 gnckfgfwgp ncterrllvr rnifdlsape kdkffayltl akhtissdyv
151 ipigtygqmk ngstpmfndi niydlfvwmh yyvsmdallg gseiwrdidf
201 aheapaflpw hrlfllrweq eiqkltgden ftipywdwrd aekcdictde
251 ymggqhptnp nllspasffs swqivcsrle eynshqslcn gtpegplrrn
301 pgnhdksrtp rlpssadvef clsltqyesg smdkaanfsf rntlegfasp
351 ltgiadasqs smhnalhiym ngtmsqvqgs andpifllhh afvdsifeqw
401 lrrhrplqev ypeanapigh nresymvpfi plyrngdffi sskdlgydys
451 ylqdsdpdsf qdyiksyleq asriwswllg aamvgavlta llaglvsllc
501 rhkrkqlpee kqpllmeked yhslyqshl
```

TABLE 14.2

Predicted MHC Class II-presented epitopes of tyrosinase.

| PEPTIDE | Pos. | Sequence | Score | Ii-Key | SEQ ID NO: |
|---|---|---|---|---|---|
| 14.2.1 | 401 | LRRHRPLQE | 6.60 | 6 | 488 |
| 14.2.2 | 179 | MHYYVSMDA | 6.40 | — | 489 |
| 14.2.3 | 400 | WLRRHRPLQ | 6.25 | 5 | 490 |
| 14.2.4 | 118 | LVRRNIFDL | 5.70 | 9 | 491 |
| 14.2.5 | 366 | LHIYMNGTM | 5.50 | — | 492 |
| 14.2.6 | 368 | IYMNGTMSQ | 5.40 | — | 493 |
| 14.2.7 | 182 | YVSMDALLG | 5.50 | — | 494 |
| 14.2.8 | 150 | VIPIGTYGQ | 5.50 | 7 | 495 |
| 14.2.9 | 338 | FSFRNTLEG | 5.40 | — | 496 |
| 14.2.10 | 498 | LLCRHKRKQ | 5.30 | — | 497 |

TABLE 14.2-continued

Predicted MHC Class II-presented epitopes of tyrosinase.

| PEPTIDE | Pos. | Sequence | Score | Ii-Key | SEQ ID NO: |
|---|---|---|---|---|---|
| 14.2.11 | 1 | MLLAVLYCL | 5.20 | — | 498 |
| 14.2.12 | 167 | FNDINIYDL | 5.20 | — | 499 |

Pos. is the residue position in the primary sequence of the first amino acid in the antigenic epitope. Sequence is the amino acid sequence of the predicted MHC Class II-presented epitope. Score is the score reported by the ProPred program, for the relative likelihood of being presented by many common HLA-DR alleles. Ii-Key is the number of residue positions intervening between an Ii-Key motif and the first residue of the antigenic epitope.

TABLE 14.3

Experimentally defined MHC Class II-presented epitopes of tyrosinase.

| PEPTIDE | Pos. | Sequence | Ii-Key | SEQ ID NO: |
|---|---|---|---|---|
| 14.3.1 | 56 | QNILLSNAPLGPQFP | — | 500 |
| 14.3.2 | 365 | ALHIYMNGTMSQVQGSA | — | 501 |
| 14.3.3 | 156 | YGQMKNGSTPMFNDINIYDL | — | 502 |

Pos. is the residue position in the primary sequence of the first amino acid in the antigenic epitope. Sequence is the amino acid sequence of the experimentally defined MHC Class II-presented epitope. Ii-Key is the number of residue positions intervening between an Ii-Key motif and the first residue of the antigenic epitope. Peptide 14.3.1 is presented by HLA-DR*0401 (Storkus W. Forum (Genova). 2000 10:256-270). Peptides 14.3.2 and 14.3.3 are presented by HLA-DR*0401 (Kierstead L. Brit J Cancer. 2001 85:1738-45). Peptide 14.3.2 contains an N-glycosylation site.

epitope. The MHC Class I-presented epitopes of Table 9.4 were predicted with the use of the online program (accessed via: bimas.dcrt.nih.gov/molbio/hla_bind/). Score is the $T_{1/2}$ of disassociation of a peptide containing this subsequence (Tsang K Y. J Natl Cancer Inst. 1995 87:982-90). Peptide

TABLE 14.4

Designed Ii-Key/tyrosinase hybrids containing some of the MHC Class II-presented epitopes of Table 14.2 and 14.3.

| PEPTIDE | Pos. | Sequence | SEQ ID NO: |
|---|---|---|---|
| | | Non-overlapping | |
| 14.4.1 | 56 | Ac-LRMK-ava-QNILLSNAPLGPQFP-NH$_2$ | 503 |
| 14.4.2 | 118 | Ac-LRMK-ava-LVRRNIFDL-NH$_2$ | 504 |
| 14.4.3 | 338 | Ac-LRMK-ava-FSFRNTLEG-NH$_2$ | 505 |
| 14.4.4 | 498 | Ac-LRMK-ava-LLCRHKRKQ-NH$_2$ | 506 |
| | | Overlapping epitopes | |
| 14.4.5 | 365 | Ac-LRMK-ava-ALHIYMNGTMSQVQGSA-NH$_2$ | 507 |
| 14.4.6 | 366 | Ac-LRMK-ava-LHIYMNGTM-NH$_2$ | 508 |
| 14.4.7 | 368 | Ac-LRMK-ava-IYMNGTMSQ-NH$_2$ | 509 |
| 14.4.8 | 365 366 and 368 | Ac-LRMK-ava-ALHIYMNGTMSQ-NH$_2$ | 510 |
| 14.4.9 | 182 | Ac-LRMK-ava-YVSMDALLG-NH$_2$ | 511 |
| 14.4.10 | 179 | Ac-LRMK-ava-MHYYVSMDA-NH$_2$ | 512 |
| 14.4.11 | 179 and 182 | Ac-LRMK-ava-MHYYVSMDALLG-NH$_2$ | 513 |
| 14.4.12 | 150 | Ac-LRMK-ava-VIPIGTYGQ-NH$_2$ | 514 |
| 14.4.13 | 156 | Ac-LRMK-ava-YGQMKNGSTPMFNDINIYDL-NH$_2$ | 515 |
| 14.4.14 | 167 | Ac-LRMK-ava-FNDINIYDL-NH$_2$ | 516 |
| 14.4.15 | 150 156 and 167 | Ac-LRMK-ava-VIPIGTYGQMKNGSTPMFNDINIYDL-NH$_2$ | 517 |

Pos. is the residue position in the primary sequence of the first amino acid in the antigenic epitope. Sequence is the amino acid sequence of a hybrid peptide containing a MHC Class II epitope of Table 1.2.

TABLE 14.5

Predicted MHC Class I-presented epitopes of tyrosinase.

| PEPTIDE | Pos. | Sequence | Score | SEQ ID NO: |
|---|---|---|---|---|
| 14.5.1 | 243 | KCDICTDEY | 25.0 | 518 |
| 14.5.2 | 369 | YMNGTMSQV | 531.4 | 519 |
| 14.5.3 | 1 | MLLAVLYCL | 309.1 | 520 |
| 14.5.4 | 207 | FLPWHRLFL | 540.5 | 521 |

Pos. is the residue position in the primary sequence of the first amino acid in the antigenic epitope. Sequence is the amino acid sequence of the predicted MHC Class II-presented epitope. 14.4.1 is presented by HLA-A1. Peptides 14.5.2, 14.5.3 and 14.5.4 are presented by HLA*A0201.

TABLE 14.6

Experimentally defined MHC Class I-presented epitopes of tyrosinase.

| PEPTIDE | Pos. | Sequence | SEQ ID NO: |
|---|---|---|---|
| 14.6.1 | 240 | DAEKSDICTDEY | 522 |
| 14.6.2 | 368 | YMDGTMSQV | 523 |
| 14.6.3 | 146 | SSDYVIPIGTY | 524 |

Pos. is the residue position in the primary sequence of the first amino acid in the antigenic epitope. Sequence is the amino acid sequence of the experimentally defined MHC Class II-presented epitope. Peptide 14.6.1 is presented by HLA-A1 (Yamshchikov G. Int J Cancer. 2001 92:703-11). Peptide 14.6.2 is presented by HLA-A2 (Yamshchikov G. Int J Cancer. 2001 92:703-11). Peptide 14.6.3 is presented by HLA-A1 (Kawakami Y. J Immunol. 1998 161:6985-92).

TABLE 14.7

Designed Ii-Key/tyrosinase hybrids containing some of the MHC Class I- and MHC Class II-presented epitopes of Tables 14.2, 14.3, 14.5, and 14.6).

| PEPTIDE | Pos. | Sequence | SEQ ID NO: |
|---|---|---|---|
| | | Non-overlapping epitopes | |
| 14.7.1 | 240 and 56 | Ac-LRMK-ava-DAEKSDICTDEY-QNILLSNAPLGPQFP-NH$_2$ | 525 |
| 14.7.2 | 207 and 401 | Ac-LRMK-ava-FLPWHRLFL-LRRHRPLQE-NH$_2$ | 526 |
| | | Overlapping epitopes | |
| 14.7.3 | 368 (371D) and 365 (366, 368) | Ac-LRMK-ava-ALHIYMNGTMSQ VQGSA-NH$_2$ | 527 |
| 14.7.4 | 146 and 156 | Ac-LRMK-ava-SSDYVIPIGTYGQ MKNGSTPM FNDINIYDL-NH$_2$ | 528 |
| 14.7.5 | 1 and 1 | Ac-LRMK-ava-MLLAVLYCL-NH$_2$ | 529 |

Pos. is the residue position in the primary sequence of the first amino acid in the antigenic epitope. Sequence is the amino acid sequence of a hybrid peptide containing a MHC Class II epitope of Table 14.2. PEPTIDE 14.7.5 includes amino acid sequences of both MHC Class I- and II-presented epitope of tyrosinase, which are experimentally defined and coincide.

Example 15

Ii-Key/Melanoma Antigen Mart-1 Antigenic Epitope Hybrids

Rosenberg and colleagues immunized metastatic melanoma patients with autologous dendritic cells presenting epitopes derived from the melanoma-associated antigens MART-1 and gp100 (Panelli M C. J. Immunother. 2000 23:487-98). The DCs were generated by 5- to 7-day incubation in interleukin-4 (1,000 U/mL) and granulocyte-macrophage colony-stimulating factor (1,000 U/mL) of peripheral blood monocytes obtained by leukapheresis. Before administration, the DCs were pulsed separately with the HLA-A*0201-associated melanoma epitopes MART-1(27-35) and gp-100-209-2M. The DCs were administered four times at 3-week intervals. A first cohort of patients (n=3) was treated with 6×10$^7$ DCs and a second cohort (n=5) with 2×10$^8$ DCs (in either case, one half of the DCs were pulsed with MART-1(27-35) and the other half was pulsed with gp-100-209-2M). In a final cohort under accrual (n=2) 2×10$^8$ DCs were administered in combination with interleukin-2 (720,000 IU/kg every 8 hours). The recovery of DCs after in vitro culture ranged from 3% to 35% (mean, 15%) of the original peripheral blood monocytes. Administration of DCs caused no symptoms at any of the doses, and the concomitant administration of interleukin-2 did not cause toxicity other than that expected for interleukin-2 alone. Monitoring of patients' cytotoxic T lymphocyte reactivity before and after treatment revealed enhancement of cytotoxic T lymphocyte reactivity only in one of five patients tested. Of seven patients evaluated for response, one had a transient partial response with regression of pulmonary and cutaneous metastases.

Ioannides and colleagues demonstrated reduced recognition of metastatic melanoma cells by autologous MART-1 specific CTL correlated to TAP deficiency (Murray J L. J. Immunother. 2000 23:28-35). Class I expression in context with T-cell receptor expression is crucial for peptide presentation and induction of CD8+ cytotoxic T lymphocytes (CTL). Presentation of MHC class I bound peptides depends on transporter-associated proteins (TAP) expression and function. Tumor infiltrating lymphocytes from a patient with melanoma were isolated, expanded in vitro in the presence of interleukin-2, and tested for cytotoxicity against HLA-A2 positive, MART-1 positive autologous tumor cells, an HLA-A2-positive, MART-1 positive melanoma cell line (Mel-501), and HLA-A2-negative melanoma cells. Significant killing occurred against both A2-positive cell lines (63% and 65%, respectively), but not against the A2-negative line (18%) or A2-positive autologous tumor (1.5%). These CTL preferentially recognized the MART-1 peptide F119, 27-35, and gp100 peptide F125, 280-288, resulting in a 30% to 60% enhancement of lysis when autologous tumor or major histocompatibility complex class I "empty" T2 cells were pulsed with either peptide. To address whether the deficiency in autologous tumor recognition might be related to a deficiency in Ag presentation, screening for the presence of TAP1 and TAP2 transcripts by polymerase chain reaction, Southern blotting, and scanning densitometry using sequence-specific primers and probes. Both TAP1 and TAP2 expression levels in the autologous tumor were minimal, yet were upregulated 7- to 18-fold, respectively, by interferon-gamma. Despite this increase, a similar increase in cytotoxicity did not occur. In short, deficiencies in TAP presentation may have functional significance for tumor escape from immunosurveillance and with respect to impending vaccine trials.

Slingluff and colleagues demonstrated terminal modifications inhibit proteolytic degradation of an immunogenic MART-1(27-35) peptide (Brinckerhoff L H. Int J Cancer 1999 Oct. 29; 83(3):326-34). The stability of the immunogenic peptide MART-1(27-35) in fresh normal human plasma (NHP) was tested to identify modifications protecting against enzymatic destruction without loss of immunogenicity. MART-1(27-35) peptide (AAGIGILTV) (SEQ ID NO: 530) and modified forms were incubated in plasma for varied time intervals and evaluated for their ability to reconstitute the epitope for MART-1(27-35)-reactive CTL. Loss of CTL reactivity signaled loss of immunoreactive peptide. When 1 microM MART-1(27-35) peptide was incubated in plasma prior to pulsing on target cells, CTL reactivity was lost within 3 hr, and the calculated half-life of this peptide was 22 sec. This degradation was mediated by peptidases. The stability of MART-1(27-35) was markedly prolonged by C-terminal amidation and/or N-terminal acetylation (peptide capping), or by polyethylene-glycol modification (PEGylation) of the C-terminus. These modified peptides were recognized by CTL.

Romero and colleagues demonstrated that CpG is an efficient adjuvant for specific CTL induction against tumor antigen-derived peptide (Miconnet I. J Immunol. 2002 168:1212-8). Mice transgenic for a chimeric MHC class I molecule were immunized with a peptide analog of MART-1/Melan-A (26-35) in the presence of CpG oligonucleotides alone or emulsified in IFA. The CTL response was monitored ex vivo by tetramer staining of lymphocytes. In blood, spleen, and lymph nodes, peptide mixed with CpG ODN alone was able to elicit a stronger systemic CTL response as compared with peptide emulsified in IFA. Moreover, CpG ODN in combination with IFA further enhanced the CTL response in terms of the frequency of tetramer+CD8+ T cells ex vivo. The CTL induced in vivo against peptide analog in the presence of CpG ODN are functional, as they were able to recognize and kill melanoma cells in vitro.

Mitchell and colleagues demonstrated synthetic insertion of signal sequences enhance MHC Class I presentation of a peptide from the melanoma antigen MART-1 (Minev B R. Eur J Immunol. 2000 30:2115-24). Addition of synthetic signal sequences at the N terminus, but not at the C terminus, of an epitope from the human melanoma antigen MART-1 enhanced its presentation in both TAP-deficient and TAP-expressing cells. A peptide construct, composed of the epitope replacing the hydrophobic part of a natural signal sequence, was also very effective. Interestingly, an artificial signal sequence containing the same epitope was the most efficient construct for enhancing its presentation. These peptide constructs facilitated epitope presentation when loaded into the cytosol of TAP-deficient T2 cells, TAP-expressing melanoma cells and human dendritic cells.

Zajac and colleagues demonstrated immunogenicity of nonreplicating recombinant vaccinia expressing HLA-A201 targeted or complete MART-1/Melan-A antigen (Schutz A. Cancer Gene Ther. 2001 8:655-61). The first recombinant virus expressed a minigene encoding a fusion product between an endoplasmic reticulum (ER)-targeting signal and the HLA-A201 binding MART-1/Melan-A 27-35 peptide. The second viral construct encoded the complete MART-1/Melan-A protein. The capacity of HLA-A201 cells infected with either viral construct to generate and to stimulate MART-1/Melan-A 27-35 specific cytotoxic T-lymphocytes (CTL), was comparatively characterized. The results obtained confirmed the capacity of vaccinia virus-encoded ER-minigene to generate a very strong antigenic signal. In cytotoxicity assays, recognition of target cells infected with high amounts of both recombinant viruses with activated specific CTL clones, resulted in similar lytic activity. With regard to calcium mobilization, TCR down-regulation, IFN-gamma release, and T cell proliferation assays, the targeted epitope elicited 10- to 1000-fold stronger responses. Remarkably, the immunogenic difference between the two formulations, in their respective capacity to generate CTL from naive HLA-A2 peripheral blood mononuclear cells in vitro as measured by tetramer detection, was lower (2- to 3-fold). Recombinant vectors expressing complete antigens have demonstrated their capacity to generate specific responses and such vaccines might take advantage of a broader potential of presentation. However, as demonstrated for the HLA-A201-restricted MART-1/Melan-A immunodominant epitope, non-replicative vaccinia virus expressing ER-targeted minigenes appear to represent a significantly more immunogenic epitope vaccine formulation. Enhanced further with Ii-RGC.

Falo and colleagues demonstrated direct transfection and activation of human cutaneous dendritic cells (Larregina A T. Gene Ther. 2001 8:608-17). A gene gun was used to transfect human skin organ cultures with a particular goal of expressing transgenic antigens in resident cutaneous dendritic cells. Gold particles delivered to human skin are observed primarily in the epidermis, even when high helium delivery pressures are used. Langerhans cells resident in the basal epidermis can be transfected, and gene gun delivery is sufficient to stimulate the activation and migration of skin dendritic cells. RT-PCR analysis of dendritic cells, which have migrated from transfected skin, demonstrates transgenic mRNA, indicating direct transfection of cutaneous dendritic cells. Transfected epidermal Langerhans cells can efficiently present a peptide derived from the transgenic melanoma antigen MART-1 to a MART-1-specific CTL.

Mule and colleagues demonstrated that administration of tumor lysate-pulsed DCs is nontoxic and capable of inducing immunological response to tumor antigen (Chang A E. Clin Cancer Res. 2002 8:1021-32). Fourteen patients with stage IV solid malignancies were treated in cohorts that received $10^6$, $10^7$, and $10^8$ dendtiric cells i.d. every 2 weeks for three vaccines. Each vaccine was composed of a mixture of half DCs pulsed with autologous tumor lysate and the other half with keyhole limpet hemocyanin (KLH). Local accumulation of CD4+ and CD8+ T cells were found at the vaccination sites. There was a significant proliferative response of PBMCs to KLH induced by the vaccine. In 5 of 6 patients, the vaccine resulted in increased IFN-gamma production by PBMCs to KLH in an ELISPOT assay. Using the same assay, 3 of 7 patients' PBMCs displayed increased IFN-gamma production in response to autologous tumor lysate. One patient with melanoma also was observed to have an increased frequency of MART-1- and gp100-reactive CD8(+) T cells after vaccination. By delayed-type hypersensitivity testing, 8 of 9 and 4 of 10 patients demonstrated reactivity to KLH and autologous tumor, respectively. Ii-Key/antigenic epitope hybrids will improve the efficiency of this immunopriming technology.

Kourilsky and colleagues demonstrated cross-presentation by dendritic cells of tumor antigen expressed in apoptotic recombinant canarypox virus-infected dendritic cells (Motta I. J Immunol. 2001 167:1795-802). Recombinant canarypox virus (ALVAC) encoding the melanoma-associated Ag, Melan-A/MART-1 (MART-1), was tested in cancer immunotherapy, using a dendritic cell (DC)-based approach. ALVAC MART-1-infected DC express, and process and present, the antigen encoded by the viral vector. One consistent feature of infection by ALVAC was induction of apoptosis, and cross-presentation of Ag when uninfected DC are cocultured with ALVAC MART-1-infected DC. Uptake of apoptotic virally infected DC by uninfected DC and subsequent expression of tumor antigen in the latter were verified by flow cytometry analysis, image cytometry, and confocal microscopy. Functional activity was monitored in vitro by the stimulation of a MART-1-specific cytotoxic T cell clone. Heightened efficiency in Ag presentation was indicated by 2- to 3-fold increase in IFN-gamma production by the T cell clone, as compared with the ALVAC-infected DC alone. Cocultures of ALVAC MART-1-infected and uninfected DC are able to induce MART-1-specific T cell immune responses, as assessed by HLA class I/peptide tetramer binding, IFN-gamma ELISPOT assays, and cytotoxicity tests.

The amino acid sequence of melanoma antigen MART-1 as given in GenBank as 1082589|pir||A55253 melanoma antigen MART-1-human is presented in Table 15.1. Predicted MHC Class II-presented epitopes of MART-1/Melan-A are listed in Table 15.2. Experimentally defined MHC Class II-presented epitopes of MART-1/Melan-A are listed in Table 15.3. Designed Ii-Key/MART-1/Melan-1 hybrids containing some of the MHC Class II-presented epitopes of Tables 15.2 and 15.3 are listed in Table 15.4. Predicted MHC Class I-presented epitopes of MART-1/Melan-A are listed in Table 15.5. Experimentally defined MHC Class I-presented epitopes of MART-1/Melan-A are listed in Table 15.6. Designed Ii-Key/MART-1 hybrids containing some of the MHC Class I- and Class II-presented epitopes of Tables 15.2, 15.3, 15.5, and 15.6 are listed in Table 15.7.

TABLE 15.1

Deduced amino acid sequence of melanoma antigen MART-1. (SEQ ID NO: 531)

```
  1 mpredahfiy gypkkghghs yttaeeaagi giltvilgvl
    lligcwycrr 51 rngyralmdk slhvgtqcal trrcpqegfd hrdskvslqe
    kncepvvpna 101 ppayeklsae qspppysp
```

TABLE 15.2

Predicted MHC Class II-presented epitopes of MART-1/Melan-A.

| PEPTIDE | Pos. | Sequence | Score | Ii-Key | SEQ ID NO: |
|---|---|---|---|---|---|
| 15.2.1 | 33 | LTVILGVLL | 5.00 | — | 532 |
| 15.2.2 | 35 | VILGVLLLI | 4.70 | — | 533 |
| 15.2.3 | 96 | VVPNAPPAY | 4.10 | 6 | 534 |
| 15.2.4 | 30 | IGILTVILG | 4.28 | — | 535 |
| 15.2.5 | 9 | IYGYPKKGH | 4.10-5.10 | — | 536 |

Pos. is the residue position in the primary sequence of the first amino acid in the antigenic epitope. Sequence is the amino acid sequence of the predicted MHC Class II-presented epitope. Score is the score reported by the ProPred program, for the relative likelihood of being presented by many common HLA-DR alleles. Ii-Key is the number of residue positions intervening between an Ii-Key motif and the first residue of the antigenic epitope.

TABLE 15.3

Experimentally defined MHC Class II-presented epitopes of MART-1/Melan-A.

| PEPTIDE | Pos. | Sequence | Ii-Key | SEQ ID NO: |
|---|---|---|---|---|
| 15.3.1 | 51 | RNGYRALMDKSLHVGTQCALTRR | — | 537 |

Pos. is the residue position in the primary sequence of the first amino acid in the antigenic epitope. Sequence is the amino acid sequence of the predicted MHC Class II-presented epitope. Ii-Key is the number of residue positions intervening between an Ii-Key motif and the first residue of the antigenic epitope. Peptide 15.3.1 is presented by HLA-DR4 (Zarour H. Proc Natl Acad Sci USA. 2000 97:400-5).

TABLE 15.4

Designed Ii-Key/MART-1/Melan-1 hybrids containing some of the MHC Class II-presented epitopes of Table 1.

| PEPTIDE | Pos. | Sequence | SEQ ID NO: |
|---|---|---|---|
| Non-overlapping | | | |
| 15.4.1 | 95 | Ac-LRMK-ava-VVPNAPPAY-NH$_2$ | 538 |
| 15.4.2 | 8 | Ac-LRMK-ava-IYGYPKKGH-NH$_2$ | 539 |
| 15.4.3 | 51 | Ac-LRMK-ava-RNGYRALMDKSLHVGTQCALTRR-NH$_2$ | 540 |
| B. Overlapping | | | |
| 15.4.4 | 32 | Ac-LRMK-ava-LTVILGVLL-NH$_2$ | 541 |
| 15.4.5 | 34 | Ac-LRMK-ava-VILGVLLLI-NH$_2$ | 542 |
| 15.4.6 | 29 | Ac-LRMK-ava-IGILTVILG-NH$_2$ | 543 |
| 15.4.7 | 29/32/34 | Ac-LRMK-ava-IGILTVILGVLLLI-NH$_2$ | 544 |

Pos. is the residue position in the primary sequence of the first amino acid in the antigenic epitope. Sequence is the amino acid sequence of a hybrid peptide containing a MHC Class II epitope of Table 15.2.

TABLE 15.5

Predicted MHC Class I-presented epitopes of MART-1/Melan-A.

| PEPTIDE | Pos. | Sequence | Score | SEQ ID NO: |
|---|---|---|---|---|
| 15.5.1 | 40 | LLLIGCWYC | 1289.01 | 545 |
| 15.5.2 | 56 | ALMDKSLHV | 1055.10 | 546 |
| 15.5.3 | 25 | EEAAGIGIL | 40.0 | 547 |
| 15.5.4 | 109 | AEQSPPPYS | 12.0 | 548 |

Pos. is the residue position in the primary sequence of the first amino acid in the antigenic epitope. Sequence is the amino acid sequence of a hybrid peptide containing a MHC Class II epitope of Table 1.2. The MHC Class I-presented epitopes of Table 9.4 were predicted with the use of the online program at (accessed via: bimas.dcrt.nih.gov/molbio/hla_bind/). Score is the $T_{1/2}$ of disassociation of a peptide containing this subsequence (Tsang K Y. J Natl Cancer Inst. 1995 87:982-90). Peptide 15.5.1 is presented by HLA-A*0201, HLA-A3, and HLA-A31. Peptide 15.5.2 is presented by HLA-A*0201. Peptides 15.5.3 and 15.5.4 are presented by HLA-B40.

TABLE 15.6

Experimentally defined MHC Class I-presented epitopes of MART-1/Melan-A.

| PEPTIDE | Pos. | Sequence | SEQ ID NO: |
|---|---|---|---|
| 15.6.1 | 27 | AAGIGILTV | 549 |
| 15.6.2 | 32 | ILTVILGVL | 550 |
| 15.6.3 | 24 | AEEAAGIGILT | 551 |

Pos. is the residue position in the primary sequence of the first amino acid in the antigenic epitope. Sequence is the amino acid sequence of the experimentally defined MHC Class II-presented epitope. Peptide 15.6.1 is presented by HLA-A*0201 (Kawakami, Y. J Exp Med. 1994 180:347-52). Peptide 15.6.2 is presented by HLA-A*0201 (Castelli C. J Exp Med. 1995 181:63-8). Peptide 15.6.3 is presented by HLA-B*4501 (Schneider J. Intl J Cancer. 1998 75:451-8).

TABLE 15.7

Designed Ii-Key/MART-1 hybrids containing some of the MHC Class I- and Class II-presented epitopes of 15.2, 15.3, 15.5, and 15.6).

| SEQ ID NO: | Pos. | Sequence | SEQ ID NO: |
|---|---|---|---|
| 15.7.1 | 27 and 51 | Ac-LRMK-ava-AAGIGILTV-RNGYRALMDKSLHVGTQCALT RR-NH$_2$ | 552 |

Pos. is the residue position in the primary sequence of the first amino acid in the antigenic epitope. Sequence is the amino acid sequence of a hybrid peptide containing a MHC Class II-presented epitope of Table 15.2 and a MHC Class I-presented epitope of Table 15.6.

Example 16

Ii-Key/her-2 Neu Antigenic Epitope Hybrids

Immunotherapy directed against the epidermal growth factor receptor which is overexpressed on some cancer cells can control the growth of those tumors. HER-2/neu is over-expressed on tumors in up to 30% of patients with invasive breast cancer and that over-expression is associated with poor clinical outcome. Carr et al. demonstrated in a retrospective consecutive series from 1995 to 1999 that the HER-2/neu gene was amplified in invasive breast carcinomas of 40 of 90 patients (43%) (Carr J A. Arch Surg. 2000 135:1469-7420). Following initial therapy, patients with HER-2/neu amplification had a shorter median disease-free interval (22 months) than did patients with breast cancers not amplifying that gene (40 months; p=0.003). Disease recurred in seventy-two (72%) patients, with 18 (25%) recurring locally. HER-2/neu gene amplification is an independent prognostic indicator for a subset of breast cancer patients who are at high risk for early recurrence regardless of tumor grade, estrogen/progesterone receptor status, and lymph node status. In both early stage, lymph node-negative and node-positive disease, as well as in women with metastatic disease, HER-2/neu overexpression is associated with worse survival. Women with tumors that overexpress HER-2/neu have a less favorable outcome despite adjuvant treatment with either hormonal therapy or chemotherapy. Among HER-2/neu-negative, early stage patients in the Naples GUN trial, tamoxifen benefited overall survival. However, among patients with HER-2/neu-gene amplification, tamoxifen did not improve survival (De Placido S. Br J Cancer. 1990 62:643-6). HER-2/neu over-expression is an independent predictor for tamoxifen failure. Over-expression of HER-2/neu is selective for tumor cells and is observed early in the course of malignant transformation. More importantly, the cytological characteristics of HER-2/neu over-expression (32%) in primary and metastatic lesions is nearly identical (Masood S. Ann Clin Lab Sci. 2000 30:259-65). Inasmuch as micrometastases are the primary source of relapse following primary therapy and HER-2/neu is over-expressed in metastases, HER-2/neu is an excellent target for immunotherapy of patients with early disease, both to consolidate the anti-tumor response locally and to eradicate micrometastases. Likewise, HER-2/neu should be targeted in conjunction with other major treatment regimens in patients who have relapsed following initial therapy.

Of many approaches to targeting HER-2/neu, the clinically most advanced approach is passive immunotherapy with trastuzumab (Herceptin®), an FDA-approved humanized monoclonal antibody that binds to the extracellular domain of the HER-2/neu receptor for epidermal growth factor (EGF). This monoclonal antibody is indicated both as a single agent and in combination with classical chemotherapies. Slamon et al. evaluated Herceptin® in combination with doxorubicin and cyclophosphamide (AC), or paclitaxel in 496 women with metastatic breast carcinomas that over expressed HER-2/neu (Vogel C L. J Clin Oncol. 2002 20:719-26; Slamon D J. N Engl J Med. 2001 344:783-92). Patients receiving Herceptin®, as compared to patients randomized to chemotherapy alone (either paclitaxel or AC), had a significantly longer time to disease progression (7.4 mo vs. 4.6 mo; p<0.0001), a higher rate of objective response (50% vs. 32%; p<0.001), a longer duration of response (median 9.1 vs. 6.1; p<0.001), a higher 1 year survival rate (78% vs. 67%; p=0.008), longer survival (median survival 25.1 mo vs. 20.3 mo; p=0.046), and a 20% reduction in the risk of death.

While clinical trials might proceed to alternate trastuzumab dosing regimens and combination therapies, one can suggest that the mechanism of action of trastuzumab will not lead to significantly increased efficacy. Specifically, Trastuzumab blocks the HER-2/neu EGF receptor and induces antibody dependent cellular cytotoxicity (Sliwkowski M X. Semin Oncol. 1999 4 Suppl 12:60-70). ADCC does not lead to antigen-specific memory of T- or B-lymphocytes, nor does it induce proliferation of antigen-specific cytotoxic T-lymphocytes.

HER-2/neu is also the target for several vaccine trials to induce an active specific immune response. In the NCI PDQ, three current clinical trials use HER-2/neu protein, antigen-pulsed dendritic cells, liposome-encapsulated HER-2/neu MHC peptide epitopes, and a DNA vaccine (www.cancer.gov/cancer_information/doc.aspx?viewid=F2AFAEA4-64BD-4E44-B421-56026E252389). The rationale, of course, is to enhance therapeutic efficacy and clinical ease of administration by inducing: (1) antigen-specific CD8$^+$ and CD4$^+$ lymphocytes; (2) autoantibodies against HER-2/neu with memory B-cells; and (3) memory helper T cells.

Compared to cell-based vaccines, DNA vaccines, and gene therapy approaches, peptide vaccination is preferred for several reasons. Specifically, peptide vaccines are: (1) easily constructed and manufactured; (2) chemically stable; (3) free of adventitious agents and other pathogens; and, (4) devoid of oncogenic potential. Until recently, most groups have focused on the use of MHC Class I peptide vaccines, which have triggered low-intensity CD8+ cytotoxic T cell responses. Shiku and colleagues have identified a novel human Her-2/neu2-derived peptide which is homologous to a mouse H-2K$^d$-restricted tumor antigen induces HLA-A24-restricted cytotoxic T lymphocytes in ovarian cancer patients and healthy individuals (Okugawa T. Eur J Immunol. 2000 30:3338-46; Ikuta Y. Int J Cancer. 2000 87: 553-8; Nagata Y. J Immunol. 1997 159:1336-43). In addition they have demonstrated presentation of a MHC Class I-binding peptide by monocyte-derived dendritic cells incorporating a hydrophobized polysaccharide-truncated Her-2/neu protein complex (Ikuta Y. Blood. 2002 99:3717-24; Araki H. Br J Haematol. 2001 114:681-9).

Peptide vaccines do enhance responses by CTL cells recognizing MHC Class I-presented peptides, but can be augmented by also immunizing T helper cells with MHC Class II-presented peptides. HER-2/neu-derived, MHC Class II-presented peptides are expressed by human breast, colorectal and pancreatic adenocarcinomas and are recognized by in vitro-induced, specific CD4+ T cell clones (Perez S. Cancer Immunol Immunother. 2002 50:615-24; Sotiriadou R. Br J Cancer. 2001 85:1527-34). Murray et al. showed that the Her-2/neu(777-789) peptide induced peripheral blood mononuclear cells from patients with metastatic breast cancer to secrete IFN-γ (Murray J L. Semin Oncol. 2000 27 Suppl:71-5). This group also showed that Her-2/neu(369-377) induced strong CTL response in peripheral blood mononuclear cells from healthy donors (Anderson B W. Clin Cancer Res. 2000 6:4192-200; Anderson B W. Cancer Immunol Immunother. 2000 49:459-68), as well as the secretion of CXC chemokine IP-10 from peripheral blood mononuclear cells from breast cancer patients and healthy donors (Lee T V. J Interferon Cytokine Res. 2000 20:391-401). However, in a clinical trial with that MHC Class I peptide only 3/9 patients had lymphocyte proliferative responses that were above baseline following vaccination (Murray J L. Semin Oncol. 2000 27 Suppl: 71-5). Increased CTL proliferation and IFN-ã levels were seen in stimulated cultures of peripheral blood mononuclear cells of only one vaccinated patient. In 3 of 5 patients, IFN-ã and CTL activity were increased significantly by IL-12 addition, indicating that weak antigen presentation leads to weak CTL induction, which is reversed partially in vitro with pro-inflammatory cytokines. However, MHC Class I peptide immunization does not induce helper CD4+ T cell responses. For this reason, peptide vaccines are sought with either only a MHC Class II presented, CD4+ T-helper cell stimulating epitope or with a peptide in which a MHC Class II-presented, CD4+ T-helper cell stimulating epitope overlays a MHC Class I-presented, CD8+ T-cytotoxic cell stimulating epitope.

Peripheral blood mononuclear cells from healthy donors and ovarian cancer patients do respond to Her-2/neu peptides (Fisk B. Anticancer Res. 1997 17:45-53). Peptide sequences from Her-2/neu containing anchors for major human MHC-class II molecules induced proliferative and cytokine responses at a higher frequency in healthy donors than in ovarian cancer patients. Four Her-2/neu peptides of sequences: 396-406, 474-487, 777-789, and 884-899 stimulated proliferation of a larger number of healthy donors than three other distinct HER-2 peptides 449-464, 975-987 and 1086-1098. The pattern of responses of twenty-five ovarian cancer patients was different from that of healthy donors. T cell lines were developed by stimulation with peptides of peripheral blood mononuclear cells of an ovarian cancer patient who showed a stable response to all four Her-2/neu peptides over six months. Each T cell line differed in secretion of IFN-gamma and IL-10. These results demonstrate (a) that Her-2/neu peptides can stimulate expansion of T cells in both healthy donors and ovarian cancer patients, and (b) different peptides induce different cytokine secretion patterns (J Interferon Cytokine Res. 2002 May; 22(5):583-92).

Ioannides and colleagues demonstrated axillary lymph nodes from patients with breast carcinoma respond to HER-2/neu peptides (Kuerer H M. J Interferon Cytokine Res. 2002 22:583-92). Freshly isolated lymphocytes from lymph nodes of 7 women undergoing surgery for invasive breast cancer were stimulated with HER-2/neu peptides at 50 ÿgm/ml and with control antigens. IFN-γ, IL-4, and IL-10 levels were determined at priming and at restimulation with HER-2/neu peptides. Lymphocytes isolated from the axillary lymph nodes of the patients responded to HER-2/neu peptides, proliferating and specific cytokine production. Proliferative responses to HER-2/neu peptides were seen in lymphocytes of patients with and without overexpression of HER-2/neu in the primary tumor. In some patients, the proliferative response to HER-2/neu peptides in lymphocytes from lymph nodes with metastases was absent or decreased compared to response in lymphocytes from lymph nodes without metastases from the same patient (p<0.05). HER-2/neu peptides induced a predominantly T helper type 1 (Th1) pattern of cytokine response in nodal lymphocytes isolated from breast cancer patients. A Th1-specific cytokine production pattern was maintained at priming and restimulation with HER-2/neu peptides and was amplified with IL-12 costimulation. These results indicate that HER-2/neu peptides can activate T cells in draining lymph nodes from women with invasive breast cancer.

Patients immunized with an HLA-A2-presented, Her-2/neu peptide developed only a low level and short-lived CTL response, in the absence of concurrent vaccination with a MHC Class II-presented epitope (Ward R L. Hum Immunol. 1999 60:510-5). Six HLA-A2 patients with Her-2/neu-over-expressing cancers received 6 monthly vaccinations with a vaccine preparation consisting of 500 µg of Her-2/neu(369-377) peptide, admixed with 100 µg of GM-CSF. The patients had either stage III or IV breast or ovarian cancer. Immune responses to the Her-2/neu(369-377) peptide were examined using an IFN-γ enzyme-linked immunosorbent spot assay. Although HER-2/neu MHC class I epitopes induced HER-2/neu peptide-specific IFN-γ-producing CD8+ T cells, the magnitudes of the responses were low, as well as short-lived, indicating that CD4+ T-cell help is required for robust and lasting immunity to this epitope.

Disis and colleagues immunized with breast cancer patients a HER-2/neu helper peptide vaccine generating HER-2/neu CD8 T-cell immunity (Knutson K L. J Clin Invest. 2001 107:477-84). Nineteen HLA-A2 patients with HER-2/neu-overexpressing cancers received a vaccine preparation consisting of Her-2/neu(369-384), Her-2/neu (688-703), and Her-2/neu(971-984). Contained within these sequences are HLA-A2-binding motifs Her-2/neu(369-377), Her-2/neu(689-697), and Her-2/neu(971-979). After vaccination, the mean peptide-specific T-cell precursor frequency to the HLA-A2 peptides increased in the majority of patients. In addition, the peptide-specific T cells were able to lyse tumors. The responses were long-lived and detected for more than 1 year after the final vaccination in some patients. These results demonstrate that Her-2/neu MHC class II epitopes containing overlaying MHC Class I epitopes induce long-lasting Her-2/neu-specific IFN-ÿ-producing CD8+ T cells.

Disis and colleagues immunized sixty-four patients with HER-2/neu-overexpressing breast, ovarian, or non-small-cell lung cancers with vaccines composed of peptides derived from potential T-helper epitopes of the HER-2/neu protein mixed with granulocyte-macrophage colony-stimulating factor and administered intradermally (Disis M L. J Clin Oncol. 2002 20:2624-32). Nine different epitopes were used: 3 derived from the intracellular domain of her-2/neu (p776-790, p927-941, and p1166-1180), 3 derived from the extracellular domain of her-2/neu (p42-56, p98-114, and p328-345), and 3 with helper epitopes that encompass in their natural sequence HLA-A2 binding motifs (p369-384, p688-703, and p971-984). Ninety-two percent of patients developed T-cell immunity to HER-2/neu peptides and 68% to a HER-2/neu protein domain. Epitope spreading was observed in 84% of patients and correlated with the generation of a HER-2/neu protein-specific T-cell immunity (P=0.03). At 1-year follow-up, immunity to the HER-2/neu protein persisted in 38% of patients. No patient developed any detected autoimmune toxicity, particularly in organs known to express basal levels of her-2/neu protein including the liver, digestive tract, and skin. The incorporation of MHC Class II epitopes used in this study in Ii-Key hybrid molecules might lead to more rapid anti-her-2/neu immune responses with lower and fewer doses, greater epitope spreading, induction of higher affinity T-cells against tumor, more prolonged immune responses against epitopes and her-2/neu protein, and greater clinical efficacy.

Finding tumor-reactive CTLs in tumor infiltrates and in the peripheral blood of cancer patients, raises the question that any anti-tumor immune response does not control disease spread (Anderson B W. Clin Cancer Res. 2000 6:4192-200). One might then question whether amplification of this response by peptide vaccines is useful during disease progression. Induction of tumor-reactive CTLs in healthy donors at risk, as well as in patients free of disease, has been proposed on the hypothesis that CTLs that recognize tumors early are more effective in containing their progression than CTLs that expand only when the disease progresses. Priming of cytolytic T cell activity in 10 healthy donors was tested with Her-2/neu(369-377) peptide as an immunogen and autologous peripheral blood mononuclear cell-derived dendritic cells as antigen presenting cells. Of those two responded at priming with Her-2/neu(369-377) peptide presented on autologous dendritic cells by induction of Her-2/neu(369-377) peptide-specific CTL activity. Three other responders were identified after two additional restimulations. Induction of cytolytic activity at priming was enhanced in responders by tumor necrosis factor-alpha and IL-12 but not in the non-responders.

Determinant spreading and Th1 responses were induced by in vitro stimulation with Her-2/neu peptides (Anderson B W. Cancer Immunol Immunother 2000 49:459-68). The induction of a response to Her-2/neu(776-789) induced reactivity to other Her-2/neu peptides. Her-2/neu(776-789) expanded a response to Her-2/neu (884-899) in both an ovarian cancer patient with progressive disease and a healthy donor who shared HLA-DR11. This response was characterized mainly by increased IFN-ÿ secretion, and proliferation, but did not occur with another donor who shared only HLA-DR14 and HLA-DQ5 with the patient. Epitope spreading can also be enhanced by the coordinated use of Ii-Key/antigenic epitope hybrids immunizations with Ii reverse gene construct, Her-2/neu gene immunizations.

Hess and colleagues found that a chimeric construct of an MHC class II binding peptide from Her-2/neu and the N-terminal flanking region of CLIP elicited potent antitumor activity against a Her-2/neu-positive tumor in a rat model system (Hess A D. Clin Immunol 2001 101:67-76). Induction of effective antitumor immunity required presentation of the chimeric peptide on irradiated tumor cells or in concert with a Her-2/neu MHC class I-restricted peptide from Her-2/neu. Adoptive transfer studies showed the need for CD4 T helper cells for protective antitumor immunity. Immunization with the epitope-only peptide caused a weak immune response to the unmodified peptide in vitro of both type 1 (IL-2, IFN-γ) and type 2 (IL-4, IL-10) cytokine-producing cells analyzed by RT-PCR (qualitative and quantitative) and by limiting dilution assay. Comparatively, immunization with the chimeric construct elicited a potent immune response to the parent epitope with predominantly type 1 cytokine-producing cells.

Accelerated Her-2/neu degradation enhanced ovarian tumor recognition by CTL (Castilleja A. Mol Cell Biochem. 2001 217:21-33). In those studies, Her-2/neu degradation was enhanced in the ovarian tumor line, SKOV3.A2, that constitutively overexpressed Her-2/neu by the addition of geldanamycin, which down-modulated Her-2/neu from the cell surface and promoted its polyubiquitinylation and degradation. Presentation of the immunodominant cytotoxic T lymphocyte (CTL) epitope, Her-2/neu(369-377) from SKOV.A2 was inhibited by proteosome inhibitors, such as LLnL. Additional experiments indicated that the newly synthesized Her-2/neu in the presence of GA was the main source of epitopes recognized by CTL. Twenty-hour GA-treated SKOV3.A2 cells were better inducers of CTL activity directed to a number of Her-2/neu CTL epitopes, in peripheral blood mononuclear cells compared with control untreated SKOV3.A2 cells thereby promoting immunogenecity. Similarly geldanamycin and other compounds acting by a similar mechanism, are expected to enhance binding of MHC Class II epitopes in the ER in the absence of Ii protein.

Ward and colleagues used phage-displayed ErbB-2 gene fragment libraries and synthetic peptides to epitope-map a panel of anti-Her-2/neu monoclonal antibodies (Yip Y L. Cancer Immunol Immunother. 2002 50:569-87; Yip Y L. J Immunol. 2001 166:5271-8). The epitopes of three monoclonal antibodies, N12, N28, and L87, were successfully located to Her-2/neu(C531-A586), Her-2/neu(T216-C235), and Her-2/neu(C220-C235) of Her-2/neu, respectively. It was found that while N12 inhibited tumor cell proliferation, N28 stimulated the proliferation of a subset of breast cancer cell lines over-expressing Her-2/neu. The peptide region recognized by N12, Her-2/neu(C531-A586), was used as an immunogen to selectively induce an inhibitory immune response in mice. Mice immunized with the GST fusion peptide, GST-Her-2/neu(C531-A586), recognized native Her-2/neu, the peptide Her-2/neu(531-586), three 15-amino acid peptides of Her-2/neu(533-548), Her-2/neu(545-5560), and Her-2/neu (571-586). More importantly, immunoglobulins purified from mouse sera were able to inhibit up to 85% of tumor cell proliferation. This study supports the use of some of the potential antibody recognized determinants in the construction of Ii-Key/Her-2/neu MHC Class II-presented antigenic epitope/antibody-recognized determinant hybrids. The antibody recognized determinants are presented in Table 16.8 and hybrids containing those epitopes are presented in Table 16.9. Such hybrids containing antibody-recognized determinants might be preferred can be used for the development of both passive and active immunotherapies of Her-2/neu over-expressing tumors.

Given the experimentally identified MHC Class II-presented epitopes (above) such epitope can be synthesized within Ii-Key/Her-2/neu antigenic epitope hybrids for stimulation of a diagnostic or therapeutic immune response.

The amino acid sequence of human Her-2/neu protein [*Homo sapiens*](gi|19575768|) was obtained from GenBank (Table 16.1). An important consideration in the selection of peptides for cancer immunotherapy is the high degree of sequence homology between Her-2/neu and another member of the subclass I family of growth factor receptor (EGF-r) (Lustgarten J. Hum Immunol. 1997 52:109-18). Unlike Her-2/neu, the EGF-r is widely expressed in the body. Peptide sequences identical between Her-2/neu and the mouse or human EGF-r were not selected for two reasons. First, it is likely that T-cell tolerance to such sequences would have eliminated from the repertoire high affinity T cells with specificity for such epitopes. Second, it would be undesirable to target CTL against normal cell expressing EGF-r peptides.

Predicted MHC Class II-presented epitopes of Her-2/neu protein are presented in Table 16.2. Experimentally determined MHC Class II-restricted epitope of human Her-2/neu protein are listed in Table 16.3. Designed Ii-Key/Her-2/neu hybrids using some of the MHC Class II-presented epitopes of Tables 2 and 3 are listed in Table 16.4. Predicted MHC Class I-presented epitopes of Her-2/neu protein are listed in Table 16.5. Experimentally determined MHC Class I-presented epitopes of Her-2/neu protein are listed in Table 16.6. Designed Ii-key/MHC Class II epitope/MHC Class I epitope hybrids are listed in Table 16.7. Antibody-recognized determinants on Her-2/neu are listed in Table 16.8 Designed Ii-Key/Her-2/neu hybrids using some of the antibody-recognized determinants of Table 16.8 and MHC Class II-presented epitopes of Tables 2 and 3 are presented in Table 16.9.

TABLE 16.1

(SEQ ID NO: 553)
Deduced amino acid sequence of Her-2/neu.

```
   1 melaalcrwg lllallppga astqvctgtd mklrlpaspe thldmlrhly
  51 qgcqvvqgnl eltylptnas lsflqdiqev qgyvliahnq vrqvplqrlr
 101 ivrgtqlfed nyalavldng dplnnttpvt gaspgglrel qlrslteilk
 151 ggvliqrnpq lcyqdtilwk difhknnqla ltlidtnrsr achpcspmck
 201 gsrcwgesse dcqsltrtvc aggcarckgp lptdccheqc aagctgpkhs
 251 dclaclhfnh sgicelhcpa lvtyntdtfe smpnpegryt fgascvtacp
 301 ynylstdvgs ctlvcplhnq evtaedgtqr cekcskpcar vcyglgmehl
 351 revravtsan iqefagckki fgslaflpes fdgdpasnta plqpeqlqvf
 401 etleeitgyl yisawpdslp dlsvfqnlqv irgrilhnga ysltlqglgi
 451 swlglrslre lgsglalihh nthlcfvhtv pwdqlfrnph qallhtanrp
 501 edecvgegla chqlcarghc wgpgptqcvn csqflrgqec veecrvlqgl
 551 preyvnarhc lpchpecqpq ngsvtcfgpe adqcvacahy kdppfcvarc
 601 psgvkpdlsy mpiwkfpdee gacqpcpinc thscvdlddk gcpaeqrasp
 651 ltsiisavvg illvvvlgvv fgilikrrqq kirkytmrrl lqetelvepl
 701 tpsgampnqa qmrilketel rkvkvlgsga fgtvykgiwi pdgenvkipv
 751 aikvlrents pkankeilde ayvmagvgsp yvsrllgicl tstvqlvtql
 801 mpygclldhv renrgrlgsq dllnwcmqia kgmsyledvr lvhrdlaarn
 851 vlvkspnhvk itdfglarll dideteyhad ggkvpikwma lesilrrrft
 901 hqsdvwsygv tvwelmtfga kpydgipare ipdllekger lpqppictid
 951 vymimvkcwm idsecrprfr elvsefsrma rdpqrfvviq nedlgpaspl
1001 dstfyrslle dddmgdlvda eeylvpqqgf fcpdpapgag gmvhhrhrss
1051 strsgggdlt lglepseeea prsplapseg agsdvfdgdl gmgaakglqs
1101 lpthdpsplq rysedptvpl psetdgyvap ltcspqpeyv nqpdvrpqpp
1151 spregplpaa rpagatlerp ktlspgkngv vkdvfafgga venpeyltpq
1201 ggaapqphpp pafspafdnl yywdqdpper gappstfkgt ptaenpeylg
1251 ldvpv
```

TABLE 16.2

Predicted MHC Class II-presented epitopes of Her-2/neu protein.

| PEPTIDE | Pos. | Sequence | Score | Ii-Key | SEQ. ID. NO. |
|---|---|---|---|---|---|
| 16.2.1 | 985 | FVVIQNEDL | 7.40 | 6 | 554 |
| 16.2.2 | 98 | LRIVRGTQL | 7.30 | 4 | 555 |
| 16.2.3 | 952 | MIMVKCWMI | 7.20 | — | 556 |
| 16.2.4 | 894 | LRRRFTHQS | 7.00 | 6 | 557 |
| 16.2.5 | 684 | YTMRRLLQE | 6.70 | 6 | 558 |
| 16.2.6 | 664 | VVLGVVFGI | 5.90 | — | 559 |
| 16.2.7 | 1041 | MVHHRHRSS | 5.60 | — | 560 |
| 16.2.8 | 421 | LSVFQNLQV | 5.50 | — | 561 |
| 16.2.9 | 180 | LTLIDTNRS | 5.40 | 4 | 562 |
| 16.2.10 | 670 | FGILIKRRQ | 5.40 | — | 563 |
| 16.2.11 | 396 | LQVFETLEE | 5.20 | — | 564 |
| 16.2.12 | 61 | LTYLPTNAS | 5.10 | 11 | 565 |
| 16.2.13 | 951 | YMIMVKCWM | 5.00 | — | 566 |
| 16.2.14 | 719 | LRKVKVLGS | 5.00 | 4 | 567 |
| 16.2.15 | 424 | FQNLQVIRG | 5.20 | — | 568 |

Pos. is the residue position in the primary sequence of the first amino acid in the antigenic epitope. Sequence is the amino acid sequence of the predicted MHC Class II-presented epitope. Score is the score reported by the ProPred program, for high scoring selections with multiple common HLA-DR alleles. Ii-Key is the number of residue positions intervening between an Ii-Key motif and the first residue of the antigenic epitope.

TABLE 16.3

Experimentally determined MHC Class II-restricted epitope of human Her-2/neu protein.

| PEPTIDE | Pos. | Sequence | SEQ. ID. NO. |
|---|---|---|---|
| 16.3.1 | 884 | VPIKWMALESILRRR | 569 |
| 16.3.2 | 776 | GSPYVSRLLGICL | 570 |
| 16.3.3 | 396 | QLQVFETLEEI | 571 |
| 16.3.4 | 474 | LCFVHTVPWDQLF | 572 |
| 16.3.5 | 450 | GISWLGLRSLRE | 573 |
| 16.3.6 | 975 | EFSRMARDPQRF | 574 |
| 16.3.7 | 1086 | FDGDLGMAAKGL | 575 |
| 16.3.8 | 42 | HLDMLRHLYQGCQVV | 576 |
| 16.3.9 | 98 | LRIVRGTQLFEDNYAL | 577 |
| 16.3.10 | 328 | TQRCEKCSKPCARVCYGL | 578 |
| 16.3.11 | 776 | LGSGAFGTVYKGIWI | 579 |
| 16.3.12 | 927 | PAREIPDLLEKGERL | 580 |
| 16.3.13 | 1166 | TLERPKTLSPGKNGV | 581 |
| 16.3.14 | 369 | KKIFGSLAFLPESFDGD | 582 |
| 16.3.15 | 688 | RQQKIRKYTMRRLLQE | 583 |
| 16.3.16 | 971 | ELVSEFSRMARDPQ | 584 |

Pos. is the residue position in the primary sequence of the first amino acid in the peptide. Sequence is the amino acid sequence of the experimentally determined MHC Class II-presented epitope. Ii-Key is the number of residue positions intervening between an Ii-Key motif and the first residue of the antigenic epitope. Peptide 16.3.1 was reported by Perez S. et al. (Cancer Immunol Immunother. 2002 50:615-24). Peptide 16.3.2 was reported by Sotiriadou R. et al. (Br J Cancer. 2001 85:1527-34). Peptide 16.3.3 was reported by Fisk B. et al. (Anticancer Res. 1997 17:45-53). Peptides 16.3.8-16.3.16 are those reported in a Phase I clinical trial by Disis and colleagues (Disis M L. J Clin Oncol 2002 20:2624-32). Peptide 16.3.9 contains a predicted HLA-DRB1-0101-presented motif LRIVRTGTQL (SEQ ID NO: 585) and PEPTIDE 16.3.16 contains a DRB1-0101-presented motif LVSEFS-RMA (SEQ ID NO: 586); both stimulated lymphocytes from an immunized patients. Additional peptides in the series studied by Disis et al. might be found to containing MHC Class II-presented motifs when tested for additional HLA-DB alleles and to lower indices for scoring. Such epitopes are subject to being incorporated in Ii-Key/Her-2 antigenic epitope hybrids.

TABLE 16.4

Designed Ii-Key/Her-2/neu hybrids using some of the MHC Class II-presented epitopes of Tables 2 and 3.

| PEPTIDE | Pos. | Sequence | SEQ. ID. NO. |
|---|---|---|---|
| Non-overlapping | | | |
| 16.4.1 | 776 | Ac-LRMK-ava-GSPYVSRLLGICL-NH$_2$ | 587 |
| 16.4.2 | 396 | Ac-LRMK-ava-QLQVFETLEEI-NH$_2$ | 588 |
| 16.4.3 | 985 | Ac-LRMK-ava-FVVIQNEDL-NH$_2$ | 589 |
| 16.4.4 | 98 | Ac-LRMK-ava-LRIVRGTQL-NH$_2$ | 590 |
| 16.4.5 | 894 | Ac-LRMK-ava-LRRRFTHQS-NH$_2$ | 591 |
| 16.4.6 | 684 | Ac-LRMK-ava-YTMRRLLQE-NH$_2$ | 592 |
| 16.4.7 | 1041 | Ac-LRMK-ava-MVHHRHRSS-NH$_2$ | 593 |
| 16.4.8 | 972 | Ac-LRMK-ava-LVSEFSRMA-NH$_2$ | 594 |
| B. Overlapping | | | |
| 16.4.8 | 884, 894 | Ac-LRMK-ava-VPIKWMALESILRRRFTHQS-NH$_2$ | 595 |
| 16.4.9 | 664, 670 | Ac-LRMK-ava-VVLGVVFGILIKRRQ-NH$_2$ | 596 |

TABLE 16.4-continued

Designed Ii-Key/Her-2/neu hybrids using some of the MHC Class II-presented epitopes of Tables 2 and 3.

| PEPTIDE | Pos. | Sequence | SEQ. ID. NO. |
|---|---|---|---|
| 16.4.10 | 951, 952 | Ac-LRMK-ava-YMIMVKCWMI-NH$_2$ | 597 |
| 16.4.11 | 421, 424 | Ac-LRMK-ava-LSVFQNLQVIRG-NH$_2$ | 598 |

Pos. is the residue position in the primary sequence of the first amino acid in the antigenic epitope. Sequence is the amino acid sequence of a hybrid peptide containing a MHC Class II epitope of Table 16.2 and 16.3.

TABLE 16.5

Predicted MHC Class I-presented epitopes of Her-2/neu protein.

| PEPTIDE | Pos. | Sequence | Score | SEQ. ID. NO. |
|---|---|---|---|---|
| 16.5.1 | 661 | ILLVVVLGV | 1006.2 | 599 |
| 16.5.1 | 369 | KIFGSLAFL | 481.2 | 600 |
| 16.5.1 | 167 | ILWKDIFHK | 450.0 | 601 |
| 16.5.1 | 63 | TYLPTNASL | 360.0 | 602 |
| 16.5.2 | 106 | QLFEDNYAL | 324.1 | 603 |
| 16.5.3 | 553 | EYVNARHCL | 300.0 | 604 |
| 16.5.4 | 440 | AYSLTLQGL | 240.0 | 605 |
| 16.5.5 | 907 | SYGVTVWEL | 220.0 | 606 |
| 16.5.6 | 1022 | EYLVPQQGF | 180.0 | 607 |
| 16.5.7 | 689 | RLLQETELV | 126.1 | 608 |
| 16.5.8 | 714 | ILKETELRK | 60.0 | 609 |
| 16.5.9 | 754 | VLRENTSPK | 30.0 | 610 |
| 16.5.10 | 673 | ILIKRRQQK | 30.0 | 611 |

Pos. is the residue position in the primary sequence of the first amino acid in the antigenic epitope. Sequence is the amino acid sequence of the predicted MHC Class I-presented epitope. The MHC Class I-presented epitopes were predicted with the use of the online program (accessed via: bimas.dcrt.nih.gov/molbio/hla_bind/). Score is the $T_{1/2}$ of disassociation of a peptide containing this subsequence (Tsang K Y. J Natl Cancer Inst. 1995 87:982-90).

TABLE 16.6

Experimentally determined MHC Class I-presentedepitopes of Her-2/neu protein.

| PEPTIDE | Pos. | Sequence | SEQ. ID. NO. |
|---|---|---|---|
| 16.6.1 | 106 | QLFEDNYAL | 612 |
| 16.6.2 | 369 | KIFGSLAFL | 613 |
| 16.6.3 | 689 | RLLQETELV | 614 |
| 16.6.4 | 435 | ILHNGAYSL | 615 |
| 16.6.5 | 665 | VVLGVVFGI | 616 |
| 16.6.6 | 952 | YMIMVKCWM | 617 |
| 16.6.7 | 654 | IISAVVGIL | 618 |
| 16.6.8 | 654 | FLSAVVGILV | 619 |
| 16.6.9 | 773 | VMAGVGSPYV | 620 |
| 16.6.10 | 754 | VLRENTSPK | 621 |

Pos. is the residue position in the primary sequence of the first amino acid in the antigenic epitope. Sequence is the amino acid sequence of the experimentally defined MHC Class I-presented epitope. Peptide 16.6.1 is presented by HLA-A2.1 (Kono K. Int J Cancer. 1998 78:202-8). Peptide 16.6.2 is presented by HLA-A2.1 (Kono K. Int J Cancer. 1998 78:202-8), as confirmed by Rongcun Y., et al. (J Immunol. 1999 163:1037-44). It was also shown to be immunogenic in double transgenic mice expressing HLA-A2.1 and human CD8 (Lustgarten J. Hum Immunol. 1997 52:109-18). Peptide 16.6.3 is presented by HLA-A2.1 (Kono, K. Int J Cancer. 1998 78:202-8; Rongcun Y. J Immunol. 1999 163:1037-44). It was nonimmunogenic in the study of Lustgarten J. et al. (Hum Immunol. 1997 52:109-18). Peptides 16.6.4, 16.6.5 and 16.6.6 are presented by HLA-A2.1 (Rongcun Y. J Immunol. 1999 163:1037-44). Peptide 16.6.7 is presented by HLA-A2 (Peoples G. Proc Natl Acad Sci USA. 1995 92:432-6) and is nonimmunogenic in the study of Lustgarten, J. et al. (Hum Immunol. 1997 52:109-18). Peptide 16.6.8 is presented by HLA-A2 (Tanaka Y. Int J Cancer. 2001 94:540-4). Peptide 16.6.9 is presented by HLA-A2.1 (Lustgarten J. Hum Immunol. 1997 52:109-18). Peptide 16.6.10 is presented by HLA-A3 (Kawashima I. Cancer Res. 1999 59:431-5).

TABLE 16.7

Designed Ii-key/MHC Class II epitope/MHC Class I epitope hybrids.

| PEPTIDE | Pos. | Sequence | SEQ. ID. NO. |
|---|---|---|---|
| 16.7.1 | II: 76, I: 73 | Ac-LRMK-ava-VMAGVGSPYVSRLLGICL-NH$_2$ | 622 |
| 16.7.2 | II: 396, I: 369 | Ac-LRMK-ava-QLQVFETLEEI-KIFGSLAFL-NH$_2$ | 623 |
| 16.7.3 | II: 670, I: 673 | Ac-LRMK-ava-FGILIKRRQQK-NH$_2$ | 624 |

Pos. is the residue position in the primary sequence of the first amino acid in the antigenic epitope, with MHC Class II indicated as I: and MHC Class II indicated as II:. Sequence is the amino acid sequence of a hybrid peptide containing a MHC Class II epitope of Table 1.2.

TABLE 16.8

Antibody-recognized determinants on Her-2/neu.

| Peptide | Pos. | Sequence | SEQ ID NO: |
|---|---|---|---|
| 16.8.1 | 216 | TRTVCAGGCARCKGP | 625 |
| 16.8.2 | 220 | CAGGCARCKGPLPTD | 626 |
| 16.8.3 | 533 | QFLRQECVEECRVLQ | 627 |
| 16.8.4 | 545 | VLQGLPREYVNARHC | 628 |
| 16.8.5 | 571 | NGSVTCFGPEADQCV | 629 |

These peptides are reported to react with serums of mice which were immunized with a GST fusion protein containing the Her-2/neu(C220-C235) sequence (Yip Y L. Cancer Immunol Immunother. 2002 50:569-87; Yip Y L. J Immunol. 2001 166:5271-8).

TABLE 16.9

Designed Ii-Key/Her-2/neu hybrids using some of the antibody-recognized determinants of Table 16.8 and MHC Class II-presented pitopes of Tables 2 and 3.

| PEPTIDE | Pos. | Sequence | SEQ. ID. NO. |
|---|---|---|---|
| Non-overlapping (MHC Class II and antibody-recognized epitopes) | | | |
| 16.9.1 | 776; 216, | Ac-LRMK-ava-GSPYVSRLLGICL-220 TRTVCAGGCARCKGPLPTD-NH₂ | 630 |
| 16.9.2 | 396; 571 | Ac-LRMK-ava-QLQVFETLEEI-NGSVTCFGPEADQCV-NH₂ | 631 |
| B. Overlapping | | | |
| 16.9.3 | 534; 533 | Ac-LRMK-ava-SQFLRGQECVEECRVLQ-NH₂ | 632 |
| 16.9.4 | 555; 556 | Ac-LRMK-ava-RVLQGLPREYVNARHC-NH₂ | 633 |

Pos. is the residue position in the primary sequence of the first amino acid in the MHC Class II-presented epitope and after the semicolon is the first residue in the peptide reported to contain an antibody-recognized epitope. Sequence is the amino acid sequence of a hybrid peptide.

Example 17

Ii-Key/Anthrax MHC Class Ii Antigenic Epitope Hybrids

Ii-Key/antigenic epitope hybrids can be applied as vaccines against anthrax and other bioterrorism agents. In order to understand well the applications of Ii-Key/antigenic epitope hybrids as stand-alone vaccines or as components of a multivaccine protocol against anthrax, a review of the biology and pathogenesis of *bacillus anthracis* is useful. Likewise, the currently available vaccines against anthrax are considered in light of improvements offered by the products and methods of this disclosure. Specifically, the Ii-Key/antigenic epitope hybrid technology provides for enhanced antigen-specific T-helper cell responses, which enable existing vaccines and independently offer a significant degree of protection against anthrax infection. The Ii-Key/anthrax epitope peptide vaccine offers safety and effectiveness for use by both military and civilian populations.

Anthrax is an infectious disease caused by the spores of the bacterium, *Bacillus anthracis*, a large gram-positive, non-motile, bacterial rod. Human anthrax disease has three major forms: cutaneous, inhalational, and gastrointestinal. If untreated, anthrax in all forms can lead to septicemia and death. Early treatment of cutaneous anthrax is usually curative. Patients with gastrointestinal anthrax have reported case fatalities of 25% to 75%. Case fatality rates for inhalation anthrax are 90% to 100%. Early treatment of all forms of anthrax with antibiotics is essential because antibiotics are ineffective once the bacteria grow densely enough to secrete anthrax toxin (Leppla S H. Nature Medicine. 2001 7:659-660). Inhalational anthrax has two phases. During the first phase, which occurs within one to five days following exposure, the patient has flu-like symptoms (cough, malaise, fatigue and mild fever). The following phase includes sudden onset of severe respiratory distress, chest pain, and fever. Within a day, septic shock and death will likely occur. In the case of inhalational anthrax, antibiotic therapy is of limited benefit except when given immediately following exposure.

Anthrax toxin, the major virulence factor produced by *B. anthracis*, consists of three proteins. PA binds to human cells and forms a channel through which LF, the dominant virulence factor, enters the cytosol (Leppla S H. Nature Medicine. 2001 7:659-660). LF is a metalloproteinase that cleaves mitogen-activated protein kinases (MEKs), resulting in cell death and a clinical picture resembling septic shock. It is the binding of LF to PA63 (an area on PA that is made available following cellular binding and furin catalysis of PA) that triggers LF-PA63 binding, oligomerization, heptamer formation, and cytosolic transport of LN (Leppla S H. Bacterial protein toxins (eds. Fehrenbach F. et al.) 111-112 Gustav Fischer, New York, 1988).

Anthrax lethal toxin comprises two proteins: protective antigen (PA; MW 83 kDa) and lethal factor (LF; MW 87 kDa). The crystal structure of PA was determined in monomeric and heptameric forms (Liddington R. J Appl Microbiol. 1999 87:282-290). It bears no resemblance to other bacterial toxins of known three-dimensional structure, and defines a new structural class, which includes homologous toxins from other Gram-positive bacteria. Membrane insertion involves the water-soluble heptamer undergoing a substantial pH-induced conformational change thereby creating a 14-stranded beta-barrel. Recent work by Collier's group lends support to this model of membrane insertion (Benson E L. Biochemistry. 1998 37:3941-8). Lethal factor is the catalytic component of anthrax lethal toxin. It binds to the surface of the cell-bound PA heptamer and, following endocytosis and acidification of the endosome, translocates to the cytosol.

Liddington and colleagues determined the crystal structure of the anthrax lethal factor (Pannifer A D. Nature 2001 414:229-33). Lethal factor (LF) is highly specific protease that cleaves members of the mitogen-activated protein kinase kinase (MAPKK) family near their amino termini, leading to the inhibition of one or more signaling pathways. The crystal structure of LF and its complex with the N terminus of MAPKK-2 was determined. LF comprises four domains: domain I binds the membrane-translocating component of anthrax toxin, the protective antigen (PA); domains II, III and IV together create a long deep groove that holds the 16-residue N-terminal tail of MAPKK-2 before cleavage. Domain II resembles the ADP-ribosylating toxin from *Bacillus cereus*, but the active site has been mutated and recruited to augment substrate recognition. Domain III is inserted into domain II, and seems to have arisen from a repeated duplication of a structural element of domain II. Domain IV is distantly related to the zinc metalloprotease family, and contains the catalytic center; it also resembles domain I. The structure thus reveals a protein that has evolved through a process of gene duplication, mutation and fusion, into an enzyme with high and unusual specificity.

Proteasome activity is required for anthrax lethal toxin to kill macrophages (Tang G. Infect Immun. 1999 67:3055-60). Anthrax lethal toxin (LeTx), consisting of protective antigen (PA) and lethal factor (LF), rapidly kills primary mouse macrophages and macrophage-like cell lines. LF is translocated by PA into the cytosol of target cells, where it cleaves mitogen-activated protein kinase kinase 1 (MEK1) and possibly other proteins. Proteasome inhibitors such as acetyl-Leu-Leu-norleucinal, MG132, and lactacystin efficiently block LeTx cytotoxicity, whereas other protease inhibitors do not. Various data indicate that the proteasome mediates a toxic process initiated by LF in the cell cytosol. This process probably involves degradation of unidentified molecules that are essential for macrophage homeostasis. Moreover, this proteasome-dependent process is an early step in LeTx intoxication, but it is downstream of the cleavage by LF of MEK1 or other putative substrates.

Leppla and colleagues found oligomerization of anthrax toxin protective antigen and binding of lethal factor during endocytic uptake into mammalian cells (Singh Y. Infect Immun. 1999 67:1853-9). The protective antigen (PA) protein of anthrax toxin binds to a cellular receptor and is cleaved by cell surface furin to produce a 63-kDa fragment (PA63). The receptor-bound PA63 oligomerizes to a heptamer and acts to translocate the catalytic moieties of the toxin, lethal factor (LF) and edema factor (EF), from endosomes to the cytosol. The essential role of PA oligomerization in LF translocation was shown with PA protein cleaved at residues 313-314. The structure of the toxin proteins and the kinetics of proteolytic activation, LF binding, and internalization are balanced in a way that allows each PA63 subunit to internalize an LF molecule.

Leppla and colleagues identified three advances which point to possible therapies by inhibiting the toxin (Chaudry G J. Trends Microbiol. 2002 10:58-62). Identification of the cell surface toxin receptor could lead to the design of binding competitors and receptor decoys. Determination of the crystal structure of the lethal factor protease will facilitate ongoing efforts to develop protease inhibitors as therapies. Finally, the susceptibility of certain inbred mice to anthrax lethal toxin was associated with mutations in the kinesin-like protein Kif1C, a discovery that could help to explain how anthrax toxin kills animals.

Various vaccine strategies have been developed to protect humans against the pathological effects of PA and LF, which are released by *Bacillus anthracis*. In order to appreciate the usefulness of Ii-Key(MHC Class II and Ii-Key/MHC Class II epitope/ARD hybrids in augmenting those vaccines, it is useful to review the current state of vaccination against and treatment of anthrax infections.

During the bioterrorism attacks of late 2001 in which thousands of people were potentially exposed to anthrax spores contained in letters to elected officials and employees of media outlets, more than 30,000 individuals received prophylactic antibiotic therapy (principally ciprofloxacin and doxycycline) for 60 days. Because anthrax spores can persist in the lungs of animals for more than 60 days, these potentially exposed individuals were then offered another 40-day course of antibiotics and therapeutic vaccination with the Anthrax Vaccine Adsorbed upon completion of the initial antibiotic regimen. However, since there is only a narrow time-window for effective antibiotic therapy following exposure to anthrax spores, using antibiotics on a mass scale is not a realistic option. Prophylactic and therapeutic vaccination against anthrax and anthrax toxin is thus the most promising form of mass intervention in case of an anthrax-bioterrorism event.

Prior to its emergence as a potentially preferred bioterrorism weapon, anthrax infection was limited to animals and humans with occupations involving direct and extensive handling of animals or animal products. Approval of the current anthrax vaccine, Anthrax Vaccine Adsorbed was based on a clinical trial conducted by Philip S. Brachman in the 1950's involving U.S. mill workers who processed animal hides. Prior to the availability of this vaccine, the yearly average number of human anthrax cases was 1.2 per 100 employees in these mills. The Brachman study provided evidence for the efficacy of anthrax vaccination: (a) 26 patients developed anthrax during the study—5 inhalation and 21 cutaneous; (b) of the 5 inhalation anthrax cases, 2 patients received placebo and 3 were in the observation group; (c) four of the 5 patients with inhalation anthrax died; (d) of the 21 cases of cutaneous anthrax, 15 individuals received placebo, three were in the observation group, and two individuals were partially immunized, and one individual was fully immunized; (e) the authors calculated vaccine efficacy level of 92.5% for fully vaccinated individuals (Brachman P S. American Journal of Public Health. 1962 52:432-440).

In 1966 the CDC initiated a clinical study of a vaccine that was a modification of the vaccine used in the Brachman trial. Although both vaccines were based on immunity induced by protective antigen (PA), their methods of preparation differed. The IND trial used three lots of material produced by the Michigan Department of Public Health (MDPH). The data submitted to the Division of Biologics Standards described the CDC's experience with 16,000 doses of the anthrax vaccine administered to 7,000 study participants. Mild local reactions ranged between 3 to 36%, moderate reactions between 1 to 3%, and severe local reactions in less than 1%. Systemic reactions were reported in 4 cases over the 5-year period; these reactions included transient fever, chills, nausea, and general body aches. The vaccine was approved in 1970 for individuals who might contact animal products that might be contaminated with *B. anthracis* spores, individuals at high risk (including veterinarians), and those engaged in diagnostic or investigational activities that might bring them in contact with the spores.

In 1985 an Advisory Panel Review under the Public Health Service Act designated the anthrax vaccine produced by MDPH as a Category I product, that is safe, effective and not misbranded (Federal Register 1985 50:51002). The efficacy data from the Brachman study and the safety data from the CDC study were the basis for these findings. In May 1988, the Department of Defense (DOD) approved the prophylactic vaccination of US military personnel. In December 2001, therapeutic vaccination was also initiated in individuals previously exposed to anthrax spores (as a result of acts of bioterrorism in Florida, New York, and Washington, D.C.), and who were receiving prophylactic antibiotic therapy.

The current AVA vaccine produced by BioPort (the successor to MDPH in anthrax vaccine manufacturing) is derived from a strain of *B. anthracis* that does not cause anthrax disease. It is a cell-free filtrate containing no whole bacteria. The vaccination protocol includes an initial dose of 0.5 ml s.c., followed by 0.5 ml s.c. booster doses at 2 and 4 weeks, and 6, 12 and 18 months, with yearly boosters thereafter. The manufacturing process is difficult, costly, time consuming, limited in scale, and laden with many biologics controls. Development of a nontoxinogenic and nonencapsulated recombinant *B. anthracis* spore vaccine and lethal factor DNA vaccine have been initiated recently (Cohen S. Infect Immun. 2000 68:4549-58; Price B M. Infect Immun. 2002 69:4509-15). Also three new anthrax vaccines based on the PA protein are being studied (Friedlander A M. JAMA 1999 282:2104-6; Thomas L J. 4$^{th}$ International Conference on Anthrax. Abstracts Book. Jun. 10-13, 2001, Annapolis, Md., USA; Turnbull P C B. Curr Opin Infect Dis. 2001 13:11). Being products of biologic manufacturing, the process and controls are much more involved and wrought with regulatory issues than for simple peptides.

The Anthrax Vaccine Expert Committee (AVEC) reviewed adverse events reported to the Vaccine Adverse Event Reporting System (VAERS) (Sever J L. Pharmacoepidemiol Drug Saf. 2002 11:189-202; Geier D A. Clin Exp Rheumatol. 2002 20:217-20). Nearly half the reports noted a local injection-site adverse effect, with more than one-third of these involving a moderate to large degree of inflammation. Six events qualified as serious adverse effects, and all were judged to be certain consequences of vaccination. Three-quarters of the reports cited a systemic adverse effect (most common: flu-like symptoms, malaise, rash, arthralgia, headache), but only six individual medically important events were judged possibly or probably due to vaccine (aggravation of spondyloarthropathy (2), anaphylactoid reaction, arthritis (2), bronchiolitis obliterans organizing pneumonia). They concluded, since some cases of local inflammation involved distal paresthesia, AVEC recommends giving subcutaneous injections of AVA over the inferior deltoid instead of the triceps to avoid compression injury to the ulnar nerve.

Ii-Key/LF(MHC Class II epitope) hybrids will induce strong Th1 immune responses that will in turn augment CTL activity, macrophage-mediated bacteria lysis, and B cell-mediated antibody production. The resulting immune responses will mediate destruction of the bacteria via enhanced macrophage activation. In addition, the hybrid will provide for augmented B cell activation, which, in the setting of concomitant or subsequent exposure to LF, will hasten and enhance the production of antibodies that block binding of LF to PA, thereby preventing internalization of anthrax toxin.

Prophylactic vaccination with the Ii-Key/LF(MHC II epitope) hybrid peptide vaccine will induce memory T-helper cells that, upon subsequent exposure to B. anthracis, will activate macrophages more potently and more rapidly, thereby resulting in efficient lysis and clearance of bacteria. Priming with the Ii-Key/LF(MHC II epitope) hybrid peptide vaccine will lead to an expanded population of specific T-helper cells that will more quickly and efficiently activate B cells for antibody production upon vaccination with LF vaccine or exposure to B. anthracis. Boosting with the Ii-Key/LF(MHC Class II epitope) hybrid peptide vaccine in patients previously vaccinated or previously exposed to the disease will create a robust and rapid anamnestic response involving efficient activation of macrophages and B cells. Prior vaccination with the Ii-Key/LF(MHC II epitope) hybrid will result in more rapid stimulation of T-helper cells and activation of B-cells providing for augmented and more rapid antibody production, which is critical in the neutralization of anthrax toxin, upon exposure to a classical anthrax vaccine or the infection itself.

In another aspect Ii-Key/anthrax MHCC lass II epitope/ anthrax ARD hybrids can be used to create an effective blocking antibody eliciting vaccine. Compound peptide constructs consisting of ARDs from PA binding sites on LF, are designed with covalently linkage to the Ii-Key/antigenic epitope hybrids. In some instances the sequences of the MHC Class II epitope and an ARD overlap. These double hybrid constructs [Ii-Key/LF(MHC II epitope)/LF1-255(ARD)] trigger robust production of antibodies to LF1-255 via concomitant antigen-specific activation of T-helper cells and B-cells. The double hybrid construct focus and magnify the immune response on the most critical area, the PA63 binding site for LF. The antibodies produced following vaccination disrupt LF binding to PA63 and anthrax toxin internalization, thereby obviating the virulence of the disease. Methods of the process of developing immunization procedures with these Ii-Key/ antigenic epitope hybrids for protection against anthrax and anthrax toxins include the following. 1. The most effective double hybrid(s) (in terms of inducing the most potent CD4+ T cell immunity and blocking the binding of LF1-255 to PA63 and entry of LF1-255 into cells) are tested in vivo in animal infection models to evaluate inhibition of bacteria growth and the virulence of the lethal toxin. 2. Immunization formulations (different doses with or without adjuvants), roots of immunization (s.c. or i.v.), and immunization schedules (with or without boosts) are evaluated in animal models. Toward application in a human trial, dose, dosage schedule, formulation, cytokine adjuvant, and basic local and systemic toxicities are evaluated in a murine protective model. 3. Activation of Th memory cells is tested in groups of immunized mice at 3, 6, 9 and 12 months for potency of CD4+ cell responses on a secondary challenge with the peptide, recombinant protein, or cDNA LF vaccine. 4. The most potent human HLA-DR restricted LF epitopes are determined for human clinical application. The most potent epitope for certain HLA-DR alleles are predicted using the Rammensee program. In as much as LF MHC Class II epitope aa576-591 might be presented by both HLA-DR1 and HLA-DR4, efforts to identify other pan-DR allele binding epitopes are made. The predicted Ii-Key/LF(HLA-DR epitope) constructs are tested for activity in ex vivo human PBMC stimulation and re-stimulation studies. Th1 and Th2 responses (double staining for CD4 and IFN-γ or CD4 and IL-4) are evaluated. 5. Double hybrids of the structure Ii-Key/LF(HLA-DR)/LF1-255(ARD) are synthesized using the most active Ii-Key/LF(HLA-DR epitope) and the most active antibody determinant (ARD). These are tested in animal toxicology and pharmacokinetics studies. 6. Clinical in vivo immunization and ex vivo PBMC re-stimulation studies in volunteers are performed with double hybrids to evaluate Th1 and Th2 responses. The several most promising double hybrids are evaluated in a subsequent clinical trial in which the induction of CD4+ T cell activation (double staining of PBMC for CD4 and IFN-γ or IL-4) and blocking antibodies are evaluated. ex vivo studies of the induced antibodies are performed to evaluate inhibition of the binding of LF1-255 to PA63 and LF1-255 entry into cells. The optimal hybrid(s) are further developed as an anthrax vaccine in clinical trials involving greater numbers of individuals. Appropriate efficacy endpoints and immunological surrogates are selected based on extensive discussion with appropriate regulatory agencies.

Ii-Key hybrid anthrax vaccines have significant advantages. (1) Safety. Since the Ii-Key hybrid vaccines are small peptides, as opposed to the full-length LF or PA protein, there is less risk of inducing unwanted immune responses against extraneous regions of the protein(s) which may be cross-reactive with normal host molecules, thereby resulting in autoimmune mediated toxicity. Peptide vaccine does not have reverse affect and thus can be safely used for large military and civilian populations; (2) Efficacy. To date, vaccines based on MHC Class II epitopes have not induced robust antigen specific immune responses primarily due to low binding efficiency. The Ii-Key hybrid technology enhances the charging efficiency of MHC Class II epitopes such that strong antigen-specific immune responses that are usually seen only in the context of concomitant IL-12 administration are observed.

(3) Precise-targeting. Although current vaccines may induce high titers of polyclonal antibodies. However, these antibodies are not always against critical target, the LF binding site for PA. The Ii-Key double hybrid, Ii-Key/LF(MHC II epitope/LF1-255(ARD), will result in the production of antibodies specifically and precisely targeted to the LF binding sites for PA, thereby making efficient use of the resources brought to bear by the immune system. (4) Dual-action—the Ii-Key double hybrid will induce T-helper memory cells that will activate macrophages to effect cell-mediated bacterial lysis and clearing, as well as strong antibodies to the PA63 binding sites that will obviate the virulence of the anthrax toxin. Even in the setting of dense bacterial growth, the antibodies to PA binding sites on LF will protect from the virulent effects of the anthrax toxin. (5) Platform technology—once shown to be effective in the anthrax system, this approach is readily adaptable for use in other Category A (i.e., botulism, plague and smallpox), Category B, and Category C bioterrorism threats.

Ii-Key/LF(MHC II epitope) hybrids are designed to induce of LF-specific CD4+ T cell activation, which forms a major defense line to inhibit the growth of *B. anthracis*. Then the most potent Ii-Key/LF(MHC II epitope) hybrid are linked to putative ARDs of the PA63 binding site on LF to form double hybrids of the structure Ii-Key/LF(MHC II epitope)LF1-255 (ARD). The ARDs are chosen from the published mapping of the sites on LF for binding to PA by mutation/binding assay (Lacy D B. J Biol Chem. 2002 277:3005-10). The linkage of Ii-Key/LF(MHC Class II epitope) hybrid to ARDs will offer strong CD4+ T cell help for the induction of antibodies to the covalently linked ARDs (Golvano J. Eur J Immunol. 1990 20:2363-6. These antibodies will bind to the surface of the PA binding sites on LF and block the binding of LF to PA63. The induction of high-titered antibodies against precisely targeted binding sites creates another line of defense, which abrogates the toxicity of *B. anthracis* LF, although the bacterial infection can be ongoing. MHC Class II-presented LF epitopes predicted with the SYFPEITHI program identifies three epitopes match perfectly the consensus sequence of the H-2E$^k$ motif: LF(91-106; HISLEALSDKKKIK) (SEQ ID NO: 634) LF(249-264; EQEINLSLEELKDQR) (SEQ ID NO: 635); LF(305-320; DDIIHSLSQEEKELL) (SEQ ID NO: 636). The activity of all hybrids in T cell activation studies will be compared with epitopes unlinked to Ii-Key. T cell activation is measured by two-color staining (anti-CD4 plus anti-IFN-γ for Th1 and anti-CD4 plus anti-IL-4 for Th2). AKR or C3H mice (H-2K$^k$) are immunized (3 mice/group) with varying doses (0.8, 4, and 20 nmol) of the Ii-Key/LF (MHC II epitope) hybrids. The concentration of 20 nmol, used by Berzofsky and colleagues (Berzofsky, J. A. J Clin Invest. 1991 88: 876-84), induced optimal T cell proliferation. A much lower concentration of hybrids will induce the same or higher levels of T cell response. In the first experiment, the adjuvant emulsion consists of equal volumes of CFA containing 1 mg/ml of *Mycobacterium tuberculosis* and hybrid peptides dissolved in PBS. Mice are immunized s.c. on the left side at the base of the tail. The same amount of hybrid peptides in incomplete Freund's adjuvant (IFA) are injected into the right side at the base of the tail 9 days later. Hybrids are injected in saline intravenously according to the same schedule to test the requirement for CFA in the efficacy of hybrids. It should be noted that Ii-Key hybrids will interact directly with MHC Class II molecules on the cell surface of APCs, thereby bypassing classical MHC Class II epitope processing and rendering the adjuvant superfluous. Four days following the second injection, the activation of lymphocytes from spleen, popliteal, inguinal, and para-aortic nodes of immunized mice are determined by established two color staining for CD4 and either IFN-γ or IL-4 (Varga S M. J Immunol. 2001 166:1554-61).

Ii-Key/LF(MHC II epitope)/LF1-255(ARD) double hybrids will produce antibodies which inhibit binding of LF to PA. The binding of LF to PA and subsequent entry of LF into cells are essential for the principal toxicity of *B. anthracis* infections. Blocking the binding of LF to PA is thus an effective way to control the virulence of *B. anthracis*. Lacy et al. have identified the PA binding sites on the surface of LF 1-255 by mutation/binding assays. Nine overlapping ARDs from these sites are synthesized in Ii-Key/MHC Class II antigenic epitope/ARD hybrids. Coupling to either a carrier or a MHC Class II epitope is required in order to induce antibodies against these short peptides (Golvano J. Eur J Immunol. 1990 20:2363-6). LF has been crystallized and its functional domains have been defined (Pannifer A D. Nature 2001 414: 229-33; Lacy D B. J Biol Chem. 2002 277:3005-10). By LF mutation and PA/LF binding experiments, Lacy et al. have mapped the PA63 binding sites on LF. Mutations clustered at two locations greatly abolish the binding of LF to PA63: aa182-188 and aa223-236. Because these two clusters are located on the surface of LF, at that exposed binding site (Lacy D B. J Biol Chem. 2002 277:3005-10), they are logically good targets for developing antibodies to block the binding of LF to PA63.

In another aspect this disclosure relates to augmenting the immune response to DNA vaccines for PA or LF. The Ii-Key/ anthrax antigenic epitope hybrids of this disclosure can be applied as a prevaccine given in advance of a DNA vaccine for an anthrax-coded protein. Several examples of such vaccines follow.

Galloway and colleagues developed protection against anthrax lethal toxin challenge by immunization with plasmids encoding LF(10-254) or PA(175-764) or both (Price B M. Infect Immun. 2001 69:4509-15). Gold particles coated with either or both plasmids were gene-gun injected into mice three times at 2-week intervals. Antibody titers both PA and LF were five times greater than titers from mice immunized with either gene alone. All mice immunized with either or both plasmids survived an i.v. challenge with a lethal dose of PA+LF.

Gu and colleagues also studied comparable PA DNA vaccines (GU ML. Vaccine 1999 17:340-4). A 1:100 dilution of serum from mice immunized with PA DNA protected cells in vitro against cytotoxic concentrations of PA. 7 of 8 mice immunized three times with the PA DNA vaccine were protected against lethal challenge with a combination of anthrax protective antigen plus lethal factor. The augmentation of such immunizations with DNA vaccines for PA might be further augmented by a later boost with recombinant protective antigen. Such protein antigens will further enhance antibody production to PA because although Ii-Key hybrids augment the MHC-Class II restricted response to antigen expressed from a DNA vaccine, there is presumably not enough PA protein available extracellularly to bind to B cells for internalization and processing of MHC Class Ii epitopes to activate those B cells to progress to plasma cells and soluble immunoglobulin production.

The efficacy of Ii-Key/anthrax antigenic epitope hybrids in potentiating DNA and protein vaccines can be tested in guinea pigs, rabbits, and rhesus macaques against spore challenge by *Bacillus anthracis* isolates of diverse geographical origin (Fellows P F. Vaccine 2001 19:3241-7).

In another aspect the Ii-Key/anthrax MHC Class II epitope/ anthrax ARD hybrids can be used to elicit antibodies which block the interaction of LF with PA required for the internalization of LF into cells. Examples of the creation and use of antibodies with such protective blocking effects follow.

Georgiou and colleagues found protection against anthrax toxin by recombinant antibody fragments correlates with antigen affinity (Maynard J A. Nat Biotechnol. 2002 20:597-601). The tripartite toxin produced by *Bacillus anthracis* is the key determinant in the etiology of anthrax. They engineered a panel of toxin-neutralizing antibodies, including single-chain variable fragments (scFvs) and scFvs fused to a human constant kappa domain (scAbs), that bind to the protective antigen subunit of the toxin with equilibrium dissociation constants (K(d)) between 63 nM and 0.25 nM. The entire antibody panel showed high serum, thermal, and denaturant stability. in vitro, post-challenge protection of macrophages from the action of the holotoxin correlated with the $K^d$ of the scFv variants. Strong correlations among antibody construct affinity, serum half-life, and protection were also observed in a rat model of toxin challenge. High-affinity toxin-neutralizing antibodies can be of therapeutic value for alleviating the symptoms of anthrax toxin in infected individuals and for medium-term prophylaxis to infection.

In another aspect, this disclosure relates to Ii-Key/anthrax MHC Class II epitope/ARD hybrids to generate protective antibodies to a segment of PA binding LF for internalization into cells. Varughese and colleagues identified two such potential sites in solvent-exposed loops of domain 4 of PA (aa 679 to 693 and 704 to 723) by mutagenesis and testing of the purified proteins for toxicity in the presence of LF (Varughese M. Infect Immun. 1999 67:1860-5). Mutations were designed in these loops and were introduced by errors occurring during PCR. Substitutions within the large loop (aa 704 to 723) had no effect on PA activity. Comparisons among 28 mutant proteins showed that the large loop (aa 704 to 722) is not involved in receptor binding, whereas residues in and near the small loop (aa 679 to 693) are relevant to receptor interaction. Peptides through that small loop are good candidates for incorporation in Ii-Key/LF MHC Class II epitope/LF ARD hybrids.

Anthrax lethal factor can be used either to draw other proteins into a cell or for its toxic activity to inactivate MAP-kinase-kinase (Duesbery N S. Science 1998 280:734-7; Liu S. Cancer Res. 2000 60:6061-7; Liu S, J Biol Chem. 2001 276:17976-84).

The hybrids of this disclosure will enhance responses to subsequently administered anthrax toxoid vaccine adsorbed to alum (Pittman P R. Vaccine 2002 20:1412-20). The IM route of administering this is safe and has comparable peak anti-PA IgG antibody levels when two doses are administered 4 weeks apart compared to the licensed initial dose schedule of three doses administered 2 weeks apart.

The Ii-Key/antigenic epitope hybrids of this disclosure can be assayed in a rabbit model of inhalational anthrax (Pitt M L. Vaccine 2001 19:4768-73). A serological correlate of vaccine-induced immunity was identified in the rabbit model of inhalational anthrax. Animals are inoculated intramuscularly at 0 and 4 weeks with varying doses of Anthrax Vaccine Adsorbed ranging from a human dose to a 1:256 dilution in phosphate-buffered saline. At 6 and 10 weeks, both the quantitative anti-PA IgG ELISA and the toxin-neutralizing antibody assays were used to measure antibody levels to PA. Rabbits were aerosol-challenged at 10 weeks with a lethal dose of *Bacillus anthracis* spores. All the rabbits that received the undiluted and 1:4 dilution of vaccine survived, whereas those receiving the higher dilutions of vaccine (1:16, 1:64 and 1:256) had deaths in their groups. Results showed that antibody levels to PA at both 6 and 10 weeks were significant (P<0.0001) predictors of survival. In addition non-invasive nasal immunization can be used to vaccinate against anthrax (Gaur R. Vaccine 2002 20:2836-9). Mice were inoculated intranasally, subcutaneously or through the skin on days 0, 15 and 28 with purified PA. Intranasal and subcutaneous immunization with PA resulted in high IgG ELISA titers. High titers of IgA were observed only in intranasally immunized mice. In a cytotoxicity assay these sera protected J774A.1 cells from lethal toxin challenge.

Table 17.1 presents the deduced amino acid sequence of anthrax toxin lethal factor (GenBank gi|16974824; Pannifer A D. Nature 2001 414:229-233. (2001)). Table 17.2 presents predicted MHC Class II-presented epitopes of anthrax toxin lethal factor. Table 17.3 presents predicted MHC Class I-presented epitopes of anthrax toxin lethal factor. Designed Ii-Key/MHC Class II epitope hybrids for anthrax lethal factor are presented in Table 17.4. Table 17.5 presents designed Ii-Key/MHC Class II epitope/ARD hybrids for anthrax lethal factor. Table 17.6 presents the deduced amino acid sequence of anthrax protective antigen (GenBank gi:9280533; Cohen, S. Infect Immun. 2000 68:4549-4558). Table 17.7 presents predicted MHC Class II-presented epitopes of anthrax protective antigen. Table 17.8 presents predicted MHC Class I-presented epitopes of anthrax protective antigen. Designed Ii-Key/MHC Class II epitope hybrids for anthrax protective antigen are presented in Table 17.9. Table 17.10 presents designed Ii-Key/anthrax protective antigen MHC Class II epitope/anthrax protective antigen ARD hybrids.

TABLE 17.1

Deduced amino acid sequence of
anthrax toxin lethal factor
(SEQ ID NO: 637)

```
  1 agghgdvgmh vkekeknkde nkrkdeernk tqeehlkeim khivkievkg 51 eeavkkeaae kllekvpsdv lemykaiggk iyivdgditk hislealsed 101 kkkikdiygk dallhehyvy akegyepvlv iqssedyven tekalnvyye 151 igkilsrdil skinqpyqkf ldvlntikna sdsdgqdllf tnqlkehptd 201 fsvefleqns nevqevfaka fayyiepqhr dvlqlyapea fnymdkfneq 251 einlsleelk dqrmlsryek wekikqhyqh wsdslseegr gllkklqipi 301 epkkddiihs lsqeekellk riqidssdfl steekeflkk lqidirdsls 351 eeekellnri qvdssnplse kekeflkklk ldiqpydinq rlqdtgglid
```

TABLE 17.1-continued

Deduced amino acid sequence of
anthrax toxin lethal factor
(SEQ ID NO: 637)

```
401 spsinldvrk qykrdiqnid allhqsigst lynkiylyen mninnltatl 451 gadlvdstdn tkinrgifne fkknfkysis snymivdine rpaldnerlk 501 wriqlspdtr agylengkli lqrnigleik dvqiikqsek eyiridakvv 551 pkskidtkiq eaqlninqew nkalglpkyt klitfnvhnr yasnivesay 601 lilnewknni qsdlikkvtn ylvdgngrfv ftditlpnia eqythqdeiy 651 eqvhskglyv pesrsillhg pskgvelrnd segfihefgh avddyagyll 701 dknqsdlvtn skkfidifke egsnltsygr tneaeffaea frlmhstdha 751 erlkvqknap ktfqfindqi kfiins
```

TABLE 17.2

Predicted MHC Class II-presented epitopes
of anthrax toxin lethal factor.

| Peptide | Pos. | Sequence | Score | Allele | Ii-Key | SEQ. ID. NO: |
|---|---|---|---|---|---|---|
| 17.2.1 | 501 | WRIQLSPDT | 3.1 | 1, 4 | 0 | 638 |
| 17.2.2 | 542 | YIRIDAKVV | 2.4 | 1 | 4 | 639 |
| 17.2.3 | 741 | FRLMHSTDH | 2.4 | 1, 3, 4 | 0 | 640 |
| 17.2.4 | 521 | LQRNIGLEI | 1.6 | 1, 8(519), 15, 15(518) | 0 | 641 |
| 17.2.5 | 341 | LQIDIRDSL | 5.4 | 3 | 0 | 642 |
| 17.2.6 | 404 | INLDVRKQY | 4.5 | 3, 13(407) | 0 | 643 |
| 17.2.7 | 677 | LRNDSEGFI | 4.3 | 3 | 7 | 644 |
| 17.2.8 | 129 | LVIQSSEDY | 3.6 | 4, 11(124) | 0 | 645 |
| 17.2.9 | 698 | YLLDKNQSD | 3.0 | 4 | 8 | 646 |
| 17.2.10 | 477 | YSISSNYMI | 7.2 | 7 | 4 | 647 |
| 17.2.11 | 398 | LIDSPSINL | 6.7 | 7 | 5 | 648 |
| 17.2.12 | 595 | IVESAYLIL | 6.0 | 7 | 9 | 649 |
| 17.2.13 | 475 | FKYSISSNY | 5.5 | 7 | 2 | 650 |
| 17.2.14 | 241 | FNYMDKFNE | 4.7 | 8 | 6 | 651 |
| 17.2.15 | 375 | FLKKLKLDI | 4.2 | 8, 11 | 0 | 652 |
| 17.2.16 | 549 | VVPKSKIDT | 3.9 | 8 | 3 | 653 |
| 17.2.17 | 148 | YYEIGKILS | 3.4 | 11 | 0 | 654 |
| 17.2.18 | 416 | IQNIDALLH | 3.2 | 11 | 5 | 655 |
| 17.2.19 | 707 | LVTNSKKFI | 4.1 | 13 | 4 | 656 |
| 17.2.20 | 582 | LITFNVHNR | 3.9 | 13 | 5 | 657 |
| 17.2.21 | 527 | LEIKDVQII | 3.8 | 13 | 4 | 658 |
| 17.2.22 | 435 | IYLYENMNI | 7.5 | 15 | 7 | 659 |
| 17.2.23 | 71 | LEMYKAIGG | 4.7 | 15 | 3 | 660 |

Pos. is the first amino acid of the predicted MHC Class II-presented epitope of the specified sequence. Score is the score calculated by the ProPred program for the first of the given HLA-DRB*__01 alleles which were examined. The second listed allele is for exactly the same epitope or for an overlapping epitope for which the first amino acid position is given in parentheses.

TABLE 17.3

Predicted MHC Class I-presented epitopes of anthrax toxin lethal factor.

| PEPTIDE | Pos. | Sequence | Score | SEQ. ID. NO: |
|---|---|---|---|---|
| 17.3.1 | 684 | FIHEFGHAV | 685.4 | 661 |
| 17.3.2 | 765 | FINDQIKFI | 342.2 | 662 |
| 17.3.3 | 147 | VYYEIGKIL | 336.0 | 663 |
| 17.3.4 | 277 | HYQHWSDSL | 300.0 | 664 |
| 17.3.5 | 113 | LLHEHYVYA | 285.7 | 665 |
| 17.3.6 | 331 | STEEKEFLK | 225.0 | 666 |
| 17.3.7 | 295 | KLQIPIEPK | 135.0 | 667 |
| 17.3.8 | 659 | YVPESRSIL | 126.0 | 668 |

Pos. is the first amino acid of the epitope of the listed sequence. The score is calculated with the SPEYETHEI program for HLA-A2.

TABLE 17.4

Designed Ii-Key/MHC Class II epitope hybrids for anthrax lethal factor.

| PEPTIDE | Pos. | Sequence | SEQ. ID. NO: |
|---|---|---|---|
| 17.4.1 | 501 | Ac-LRMK-WRIQLSPDT-NH$_2$ | 669 |
| 17.4.2 | 542 | Ac-LRMK-YIRIDAKVV-NH$_2$ | 670 |
| 17.4.3 | 741 | Ac-LRMK-FRLMHSTDH-NH$_2$ | 671 |
| 17.4.4 | 519 | Ac-LRMK-LIQRNIGLEI-NH$_2$ | 672 |
| 17.4.5 | 341 | Ac-LRMK-LQIDIRDSL-NH$_2$ | 673 |
| 17.4.6 | 404 | Ac-LRMK-INLDVRKQYKRDI-NH$_2$ | 674 |

TABLE 17.4-continued

Designed Ii-Key/MHC Class II epitope hybrids for anthrax lethal factor.

| PEPTIDE | Pos. | Sequence | SEQ. ID. NO: |
|---|---|---|---|
| 17.4.7 | 677 | Ac-LRMK-LRNDSEGFI-NH$_2$ | 675 |
| 17.4.8 | 125 | Ac-LRMK-YEPVQSSEDY-NH$_2$ | 676 |

These hybrids incorporate some for the predicted MHC Class II epitopes of Table 17.3.

TABLE 17.5

Designed Ii-Key/anthrax lethal factor MHC Class II epitope/ARD hybrids.

| PEPTIDE | Pos. | Sequence | SEQ ID NO: |
|---|---|---|---|
| 17.5.1 | 166-184 II: 170 | Ac-LRMK-PYQKFLDVLNTIKNASDSD-NH$_2$ | 677 |
| 17.5.2 | 190-213 II: 191; 203 | Ac-LRMK-TNQLKEHPTDFSVEFLEQNSN EVQ-NH$_2$ | 678 |
| 17.5.3 | 200-224 II: 203, 215 | Ac-LRMK-DFSVEFLEQNSNEVQEVFAKA FAYYI-NH$_2$ | 679 |
| 17.5.4 | 228-243 II: 230 | Ac-LRMK-QHRDVLQLYAPEAFN-NH$_2$ | 680 |

Pos. is the first and last amino acids of the LF sequence, which is incorporated into the hybrid. The first amino acid of the predicted MHC Class II epitopes are listed after II:. The MHC Class II alleles predicted with high scores to present individual epitopes are the following: 170: HLA-DRB*1301. 191: HLA-DRB*0401. 203: HLA-DRB*0401. 215: HLA-DRB*0101. 230: HLA-DRB*0101. 239:HLA-DRB*0801. Only the __01 alleles were scored with the ProPred predicting program. These peptides were chose from the segment of LF(182-236) containing interaction sites for binding to PA as indicated by loss of activity upon alanine substitutions at D182, D187, Y223, H229, L235 and Y236 (Lacy D B. J Biol Chem. 2002 277:3005-10). In these hybrids the intervening sequence is supplied by the natural sequence of LF, potentially contributing to the ARD structure. Upon identification of biological activity with any of these hybrids, additional hybrids would be tested with systematic deletions/extensions of the epitope-containing peptide sequence.

TABLE 17.6

Deduced amino acid sequence of anthrax protective antigen.
(SEQ ID NO: 681)

```
  1 mkkrkvlipl malstilvss tgnleviqae vkqenrllne sesssqgllg
 51 yyfsdlnfqa pmvvtssttg dlsipssele nipsenqyfq saiwsgfikv
101 kksdeytfat sadnhvtmwv ddqevinkas nsnkirlekg rlyqikiqyq
151 renptekgld fklywtdsqn kkevissdnl qlpelkqkss nsrkkrstsa
201 gptvpdrdnd gipdsleveg ytvdvknkrt flspwisnih ekkgltkyks
251 spekwstasd pysdfekvtg ridknvspea rhplvaaypi vhvdmeniil
```

TABLE 17.6-continued

Deduced amino acid sequence of anthrax protective antigen. (SEQ ID NO: 681)

```
301 sknedqstqn tdsqtrtisk ntstsrthts evhgnaevha sffdiggsvs
351 agfsnsnsst vaidhslsla gertwaetmg lntadtarln aniryvntgt
401 apiynvlptt slvlgknqtl atikakenql sqilapnnyy psknlapial
351 naqddfsstp itmnynqfle lektkqlrld tdqvygniat ynfengrvrv
501 dtgsnwsevl pqiqettari ifngkdlnlv erriaavnps dplettkpdm
551 tlkealkiaf gfnepngnlq yqgkditefd fnfdqqtsqn iknqlaelnv
601 tniytvldki klnakmnili rdkrfhydrn niavgadesv vkeahrevin
651 sstegllni dkdirkilsg yiveiedteg lkevindryd mlnisslrqd
701 gktfidfkky ndklplyisn pnykvnvyav tkentiinps engdtstngi
751 kkilifskkg yeig
```

TABLE 17.7

Predicted MHC Class II-presented epitopes of anthrax protective antigen. (SEQ ID NOS: 682-699 respectively, in order of appearance)

| PEPTIDE | Pos. | SEQUENCE | Allele | Score |
|---|---|---|---|---|
| 17.7.1 | 404 | YNVLPTTSL | B1, B7(405) | 1.6 |
| 17.7.2 | 7 | LIPLMALST | B1 | 1.4 |
| 17.7.3 | 395 | YVNTGTAPI | B1, B3(392), B4, B7, B13(392) | 1.1, 3.9, 4.9, 7.3, 2.8, |
| 17.7.4 | 717 | YISNPNYKV | B1 | 1.0 |
| 17.7.5 | 697 | LRQDGKTFI | B3, B13(690) | 6.3, 2.8 |
| 17.7.6 | 619 | LIRDKRFHY | B3, B8(617), B13(617) | 5.9, 5.8, 4.7 |
| 17.7.7 | 610 | IKLNAKMNI | B3, B11(603), B13 | 5.3, 2.7, 4.1 |
| 17.7.8 | 625 | FHYDRNNIA | B4 | 4.9 |
| 17.7.9 | 298 | IILSKNEDQ | B4 | 3.9 |
| 17.7.10 | 174 | VISSDNLQL | B7, B15 | 6.8, 4.1 |
| 17.7.11 | 648 | VINSSTEGL | B7 | 6.8 |
| 17.7.12 | 161 | FKLYWTDSQ | B8 | 4.0 |
| 17.7.13 | 225 | VKNKRTFLS | B8, B13 | 3.5 |
| 17.7.14 | 96 | FIKVKKSDE | B8 | 2.7 |
| 17.7.15 | 752 | ILIFSKKGY | B13 | 4.9 |
| 17.7.16 | 47 | LLGYYFSDL | B15 | 4.2 |
| 17.7.17 | 663 | IRKILSGYI | B15 | 4.1 |
| 17.7.18 | 360 | VAIDHSLSL | B15 | 4.1 |

Pos. is the first amino acid of the predicted epitope. Allele is the HLA-DRB*_01 allele with a high score for presentation of the epitope. When a second allele is listed it predicts either exactly the same sequence or an overlaying sequence, the first amino acid residue position of which is given in parentheses. The score is the prediction score in the ProPred program for the given epitope and allele.

TABLE 17.8

Predicted MHC Class I epitopes of anthrax protective antigen. (SEQ ID NOS: 700-709 respectively, in order of appearance)

| PEPTIDE | Pos. | Sequence |
|---|---|---|
| 17.8.1 | 607 | ILSGYIVEI |
| 17.8.2 | 32 | AIWSGFIKV |
| 17.8.3 | 171 | FLSPWISNI |
| 17.8.4 | 328 | RLNANIRYV |
| 17.8.5 | 530 | NIKNQLAEL |
| 17.8.6 | 155 | SLEVEGYTV |
| 17.8.7 | 551 | KLNAKMNIL |
| 17.8.8 | 657 | YISNPNYKV |
| 17.8.9 | 225 | VAAYPIVHV |
| 17.8.10 | 352 | LVLGKNQTL |

Pos. is the first amino acid of the epitope of the listed sequence. The score is calculated with the SYFPEITHI program for HLA-A2.

TABLE 17.9

Designed Ii-Key/anthrax protective antigen MHC Class II epitope hybrids.

| PEPTIDE | Pos. | Sequence | SEQ. ID. NO: |
|---|---|---|---|
| 17.9.1 | 404 | Ac-LRMK-NVLPTTSL-NH$_2$ | 710 |
| 17.9.2 | 7 | Ac-LRMK-LIPLMALST-NH$_2$ | 711 |

TABLE 17.9-continued

Designed Ii-Key/anthrax protective antigen MHC Class II epitope hybrids.

| PEPTIDE | Pos. | Sequence | SEQ. ID. NO: |
|---|---|---|---|
| 17.9.3 | 395 | Ac-LRMK-VNTGTAPI-NH$_2$ | 712 |
| 17.9.4 | 717 | Ac-LRMK-YISNPNYKV-NH$_2$ | 713 |
| 17.9.5 | 697 | Ac-LRMK-LRQDGKTFI-NH$_2$ | 714 |
| 17.9.6 | 619 | Ac-LRMK-LIRDKRFHY-NH$_2$ | 715 |
| 17.9.7 | 610 | Ac-LRMK-IKLNAKMNI-NH$_2$ | 716 |
| 17.9.8 | 625 | Ac-LRMK-FHYDRNNIA-NH$_2$ | 717 |
| 17.9.9 | 298 | Ac-LRMK-IILSKNEDQ-NH$_2$ | 718 |
| 17.9.10 | 174 | Ac-LRMK-VISSDNLQL-NH$_2$ | 719 |

TABLE 17.10

Designed Ii-Key/anthrax protective antigen MHC Class II epitope/anthrax protective antigen ARD hybrids.

| PEPTIDE | Pos. | Sequence | SEQ. ID. NO: |
|---|---|---|---|
| 17.10.1 | 173-200 II: 173 | Ac-LRMK-ava-VISSDNLQLPELKQKSSNS RKKRSTSAG-NH$_2$ | 720 |
| 17.10.2 | 212-232 II: 221, 223, 225 | Ac-LRMK-PDSLEVEGYTVDVKNKRTFLS-NH$_2$ | 721 |
| 17.10.3 | 203-232 II: 221, 223, 225 | Ac-LRMK-VPDRDNDGIPDSLEVEGYTVD VKNKRTFLS-NH$_2$ | 722 |
| 17.10.4 | 664-684 II: 664, 667, 672 | Ac-LRMK-ava-IRKILSGYIVEIEDTEGLKEV-NH$_2$ | 723 |
| 17.10.5 | 685-705 II: 690, 696 | Ac-LRMK-INDRYDMLNISSLRQDGKTFI-NH$_2$ | 724 |

Pos. is the first and last amino acids of the PA sequence, which is incorporated into the hybrid. The first amino acid of the predicted MHC Class II epitopes are listed after II:. The MHC Lass II alleles predicted with high scores to present individual epitopes are the following: 173: HLA-DRB0401, 0701, 1501. 221 HLA-DRB0301. 223: HLA-DRB1101. 225: HLA-DRB0301, 801, 1101, 1301. 664: HLA-DRB0101, 0301. 690:HLA-DRB0401, 1101. 696:HLA-DRB0301. Only the **01 alleles were scored with the ProPred predicting program. In hybrids 17.10.2, 0.3, and 0.5 the intervening sequence is supplied by the natural sequence of PA, potentially contributing to the ARD structure. Upon identification of biological activity with any of these hybrids, additional hybrids would be tested with systematic deletions/extensions of the epitope-containing peptide sequence. Peptides 17.10.1 and 17.10.2 were chosen from the region PA(197-222) shown by Collier and colleagues to be sensitive to LF binding with alanine substitutions at K197, R200, P205, I207, I210 and K214 (Cunningham K. Proc Natl Acad Sci USA 2002 99:7049-53). Peptides 17.10.4 and 17.10.5 were chosen from the smaller loop of PA(679-693) shown by Leppla and colleagues to contain interaction sites for binding to PA (Varughese M. Infect Immun. 1999 67:1860-5). Upon identification of biological activity with any of these hybrids, additional hybrids would be tested with systematic deletions/extensions of the epitope-containing peptide sequence. Additional Ii-Key/PA MHC Class II epitope/ARD hybrids can be constructed with the peptides derived by phage display analyses to bind with PA-neutralizing antibodies. In these peptides the MHC Class II epitopes would be chosen from the best experimentally determined MHC class II-presented epitopes. Examples are presented in Table 17.11 for such constructs, using only a single MHC Class II-presented epitope.

TABLE 17.11

Designed Ii-Key/anthrax protective antigen MHC Class II epitope/anthrax protective antigen ARD hybrids.

| PEPTIDE | Pos. | Sequence | SEQ. ID. NO: |
|---|---|---|---|
| 17.11.1 | II: 163 | Ac-LRMK-YVNTGTAPI-NH$_2$ | 725 |
| 17.11.2 | 209-230 II: 222 | Ac-LRMK-YVNTGTAPI-NH$_2$ | 726 |
| 17.11.3 | 655-675 II: 655, 664, 667 | Ac-LRMK-ava-YVNTGTAPI-NH$_2$ | 727 |
| 17.11.4 | 655-680 II: 664, 667 | Ac-LRMK-ava-YVNTGTAPI-NH$_2$ | 728 |
| 17.11.5 | 666-680 II: 667 | Ac-LRMK-ava-YVNTGTAPI-NH$_2$ | 729 |
| 17.11.6 | 693-706 II: 693 | Ac-LRMK-ava-YVNTGTAPI-NH$_2$ | 730 |
| 17.11.7 | 688-706 II: 693 | Ac-LRMK-YVNTGTAPI-NH$_2$ | 731 |
| 17.11.8 | 686-706 II: 693 | Ac-LRMK-NGIKKILIFSKKGYEIG-NH$_2$ | 732 |

Pos. is the first amino acid of the MHC Class II-presented epitope, for which only one example is given. The best epitopes determined experimentally are favored. The sequences following that epitope are the ARD sequences discovered by Collier and colleagues by selection and sequencing of phages which interact with PA binding antibodies. Some of those antibodies inhibit internalization of LF.

Example 18

Ii-Key/Variola B5R Protein Antigenic Epitope Hybrids

Ii-Key/smallpox antigenic epitope vaccines offer robust and relatively safe protection against smallpox, when used either alone or in combination with other vaccination methods. The potency and safety of certain other vaccines such as vaccinia virus are enhanced substantially, when preceded by one or more immunizations with an Ii-Key/smallpox antigenic epitope vaccine. Protection of a large population can be achieved with solely the use of the Ii-Key/smallpox antigenic epitope hybrid vaccine or preferably with such a vaccine in which the MHC Class II epitope is joined or overlapped in sequence with a MHC Class I-presented (cytotoxic T lymphocyte inducing) epitope and/or an antibody-recognized (virus neutralizing) epitope. Immunization with Ii-Key/smallpox antigenic epitope vaccines also improves clinical outlook for individuals infected with smallpox virus without prior vaccinia immunizations. The Ii-Key/antigenic epitope hybrid vaccines will enhance the protective responses of persons receiving a preventative vaccine with either vaccinia virus or a DNA for a smallpox or vaccinia viral protein. The efficacy of vaccinia virus vaccines given to individuals immediately upon exposure or potentially exposure to smallpox ("ring vaccination"), will be accelerated in terms of the speed and potency of the protective response. The biology and clinical course of smallpox infections is reviewed in order to understand the substantial benefits brought to the prevention of smallpox by the products and methods of this Disclosure.

Variola major, the smallpox virus, belongs to the family Poxyiridae, subfamily Chordopoxyirinae, and genus *orthopoxvirus*, which includes vaccinia (the smallpox vaccine), monkey poxvirus, and several others animal poxviruses that cross-react serologically (Breman J G. N Engl J Med. 2002 346:1300-8; Moss B. in Fields B N. Fields Virology. 1996: 2637-71; Fenner F. in Fields B N. Virology. 1996: 2673-83). The poxviruses are among the largest viruses known, containing one linear, double-stranded DNA molecule of 130 to 375 kb and replicating inn the cytoplasm.

There are five patterns of smallpox infections. Variola major (ordinary smallpox) was responsible for 90% of cases in the pre-eradication era and is associated with an overall case-fatality rate of 30% (15% to 45%) in unvaccinated patients. Flat-type or malignant smallpox and hemorrhagic smallpox typically occur in patients with a defective immune system, and case fatality rates are 97% and 96% respectively. Smallpox in children is generally similar to smallpox in adults except the case fatality rate in infants is over 40%. Variola minor is the mildest form that predominated in outbreaks in the U.S. and Great Britain, with case fatality rates <1% (Fenner F. Bull WHO. 1988 1-68, 121-208; Henderson D A. JAMA. 1999 281:2127-39).

The smallpox virus enters through the respiratory tract, passing rapidly to lymph nodes to multiply in the reticuloendothelial system over 14 days. Mucous membranes in the oropharynx become infected, as well as the capillary epithelium of the dermis leading to skin lesions. Oropharyngx and skin lesions contain abundant viral particles; virus is also present in the urine and conjunctival secretions. Cytotoxic T-cells and B-cells arise to limit the infection; neutralizing antibodies appear in the first week of infection but are delayed if infection is severe (Fenner F. in Fields B N. Virology. 1996: 2673-831996; Roberts J A. Br J Exp Pathol. 1962 43:451-61; Bedson H S. J Pathol Bacteriol. 1963 85:1-20; Buller R M. Microbiol Rev. 1991 55:80-122; Zaucha G M. Lab Invest. 2001 81:1581-600; Sarkar J K. Bull World Health Organ. 1973 48:517-22). The incubation period is 7 to 17 days (mean 10 to 12). The prodromal phase, which lasts for two to three days, is characterized by severe headache, backache, and fever, all beginning abruptly (Dixon C W. Smallpox. London, 1962). Enanthema of the tongue, mouth, and oropharynx precede the rash by a day. The rash begins as small, reddish macules, which become papules with a diameter of 2 to 3 mm. The papules become vesicles with a diameter of 2 to 5 mm. Pustules of 4 to 6 mm diameter develop four to seven days after the rash. Smallpox lesions with a peripheral distribution, generally are all at the same stage of development (in contrast to chicken pox lesions). Lesions on the palms and soles persist the longest. Death from smallpox is ascribed to toxemia, associated with immune complexes, and hypotension secondary to fluid and protein loss.

Variola is transmitted predominantly from person to person by droplet inhalation, most commonly among those with close face-to-face contact (Fenner F. Bull WHO. 1988 1-68, 121-208). Airborne and fomite (laundry, bedding) transmission occurs (Dixon C W. Smallpox. London, 1962). Patients are infectious from the time of fever onset, immediately prior to rash development. Secondary attack rates range from 37% to >70% (Rao A R. Indian J Med Res. 1968 56:1826-54; Arnt N. Am J Epidemiol. 1972 94:363-70; Heiner G G. Am J Epidemiol. 1971 94:316-26), with a primary case infecting 3.6 to 6 others (Gani R. Nature. 2001 414:748-51). In the 1970s outbreaks in Yugoslavia and Germany, there were 11 to 38 infected contacts per index case (Fenner F. Bull WHO. 1988 1-68, 121-208). Thus in populations with low herd immunity, transmission rapidly creates outbreak cases before control measures take hold. Infectivity lasts until all lesions have scabbed over and the scabs have fallen off.

Patients with smallpox are treated supportively—adequate fluid intake (which is difficult due to oropharyngeal enanthema), alleviation of pain and fever, keeping skin lesions clean to prevent bacterial superinfection. Although no antivirals are approved for smallpox by the U.S. FDA, many compounds have been screened for therapeutic activity. Cidofivir (Vistide®, approved for CMV retinitis) shows activity against *orthopoxviruses*, including variola (CIDRAP/IDSA. 2002).

Smallpox vaccination began in China in 1000 AD with "variolation", administration of infectious material from an infected patient to uninfected individuals. Edward Jenner discovered in the late 1700s that cowpox protected against smallpox. Vaccinia virus, genetically distinct from cowpox, has replaced cowpox as a vaccine (CIDRAP/IDSA. 2002). Protection is afforded for 5-10 years after primary vaccination; neutralizing antibodies are detected up to 10 years in 75% of individuals receiving 2 doses of vaccine, and up to 30 years in those vaccinated with 3 doses (Henderson D A. JAMA. 1999:281:2127-39). After an intensive worldwide campaign initiated in earnest in 1967, smallpox eradication was declared in 1980. With no natural reservoirs, variola has since existed only in laboratories. The WHO has sanctioned two depositories—The Center for Disease Control and Prevention (Atlanta, Ga.) and the State Research Center of Virology and Biotechnology (the Vektor Institute) in Novosibirsk, Russia. Inappropriately available variola virus could be a weapon of terrorists. Since less than 20% of 157 million individuals vaccinated before the early 1970s (when routine vaccination was discontinued in the US) are protected today and 119 million Americans have never been vaccinated, the need and problems of vaccinating against smallpox are being considered most carefully.

The Working Group on Civilian Biodefense has identified a number of widely known organisms that could cause disease and deaths in sufficient numbers to cripple a city or region. Smallpox used as a biological weapon, is perhaps the most serious threat to civilian populations due to its ease of transmission, case-fatality rate of 30% or more among unvaccinated persons, and the absence of a specific therapy. Although smallpox has long been feared as the most terrible of all infectious diseases, its potential for devastation today is much greater than at any previous time. Routine vaccination throughout the US ceased 25 years ago. In a now highly susceptible, mobile population, smallpox would spread widely and rapidly throughout this country and the world (Henderson D A JAMA. 1999 281:2127-39; Fenner F. Bull WHO. 1988 1-68, 121-208).

The U.S. vaccinia vaccine since the 1970s, Dryvax, is a lyophilized live vaccinia virus preparation manufactured by Wyeth. The vaccine is administered on a bifurcated needle containing a droplet of the reconstituted product; the skin of the upper arm is poked approximately 15 times creating a wound producing a drop of blood. To elicit a protective response, a "Jennerian pustule" must be induced. In an effort to expand current supplies in light of bioterrorism threats, recent clinical trials have tested the protective effects of Dryvax at dilutions of 1:1, 1:5, 1:10, and 1:100 (Frey S E. N Engl J Med. 2002 346:1265-75; Frey S E. N Engl J Med. 2002 346:1275-80). A major response was observed in 95% with undiluted product, 70% with 1:10 diluted vaccine, and 15% with 1:100 diluted vaccine. One month after vaccination, 34 of the 36 subjects with major reactions developed antibody responses compared to 1 of 24 patients who did not develop Jennerian pustules (Frey S E. N Engl J Med. 2002 346:1275-80). Vigorous cytotoxic T-cell and IFN-ã responses occurred in 94% of subjects with major reactions and only 1 of 24 patients who did not develop Jennerian pustules.

Routine vaccination was discontinued in 1979 because the risk of complications from the vaccine outweighed the threat of endemic smallpox (Fenner F. Bull WHO. 1988 1-68, 121-208). A 10 state study indicated that there were 1254 complications per 1 million primary vaccinations including encephalitis, progressive vaccinia, eczema vaccinatum, generalized vaccinia, and erythema multiforme (Lane J M. J Infect Dis. 1970 122:303-9). A nationwide survey showed that the case fatality rate was 1 per 1 million primary vaccinations (Lane J M. N Engl J Med. 1969 281:1201-8). Certain groups of individuals are contraindicated to be vaccinated—those with conditions causing immunodeficiency (i.e., HIV infection, leukemia, lymphoma, generalized malignancy, agammaglobulinemia, organ transplant recipients, or therapy with alkylating agents, antimetabolites, radiation, or large doses of corticosteroids), persons with eczema, persons with household contacts who are immunodeficient or who have a history of eczema, and pregnant women.

Based on the observed morbidity and mortality associated with vaccinia vaccination in the US from 1967 to 1979, a mass smallpox preventative vaccination campaign in the U.S. general public aged 1 to 65 could result in as many as 4,600 serious adverse events and 285 deaths (excluding high-risk persons and their immediate contacts) (Kemper A R. Eff Clin Pract. 2002 5:84-6). Indeed, dictating that everyone receives the Dryvax vaccine would sentence as many as 400 people to death and many others to seriously debilitating side effects (Grand Rapids Press Apr. 10, 2002). Therefore, the CDC has recommended a "ring vaccination" or containment strategy. In this approach, the following individuals receive the vaccine following actual or potential release of variola virus: persons directly exposed to the release; persons with face-to-face or household contact with an infected patient or in close proximity (within 2 m); personnel directly involved in the evaluation, care, or transport of infected patients; laboratory personnel involved in processing specimens; and others likely to have contact with infectious materials (CDC Interim Smallpox Response Plan CDC November 2001; Vaccinia ACIP Morb Mortal Wkly Rep. 2001 50:1-25).

Compared to mass vaccination, ring vaccination is clearly not optimal the following reasons. (1) Pre-emptive voluntary vaccination eliminates the value of smallpox as a weapon, serving as an effective deterrent. (2) Ring vaccination is effective only for the eradication of small, localized outbreaks in a population with widespread immunity. In a largely non-immune mobile population, epidemic control after multiple simultaneous exposures is a vastly different challenge. (3) Ring vaccination requires prompt identification and vaccination of infected individuals within the 3-day post exposure period when the vaccination might be effective. A person might be infective for several days before smallpox is clinically obvious, therefore, identification of cases of exposure to an infected terrorist, for example, within a four-day period is logistically impossible. (4) The CDC is assuming that each infected person will infect only 2 to 3 others, however, as many as 38 secondary infections have been observed. (5) The logistical complexity of administering millions of vaccine doses in an acute emergency is daunting and likely to induce panic and collapse of the medical and public health service as was observed in the Dark Winter simulation exercise conducted by Johns Hopkins University in June 2001 (Bicknell W J. N Engl J Med. 2002 346: 1323-25; Henderson D A. JAMA. 1999 281:2127-39; Millar J D. Public Health Policy Advisory Board. 2000; Fenner F. Bull WHO. 1988:1-68, 121-208; O'Toole T. Johns Hopkins Center for Civilian Biodefense Strategies. 2001). In contrast, pre-exposure vaccination does not pose the logistical difficulties of vaccination during an outbreak and is less expensive. In addition, pre-exposure vaccination reduces the risk of infection among immunocompromised persons (Rosenthal S R. Emerg Infect Dis. 2001 7:920-6).

Improved vaccines capable of safely and rapidly eliciting long-lasting immunity against smallpox in all persons are clearly needed. Whether used in mass or ring vaccination strategies, greater safety and efficacy relative to Dryvax is required. The Ii-Key/antigenic epitope hybrid used alone or in combination with DNA vaccines will have the following preferred characteristics relative to Dryvax: (1) significantly reduced complication rate including death and debilitating side effects, (2) more rapid induction of protective antibodies and viral-specific cytotoxic T-cells (3) simpler vaccination method, (4) greater period of protection following primary vaccination, and (5) broader target population including use in immunocompromised individuals and in pregnancy.

One preferred approach to protecting large populations is administration of one or more immunizations with an Ii-Key/smallpox antigenic epitope hybrid of this Disclosure, followed according to the ring immunization concept by vaccinia or similar viral vaccines in the population subset of exposed or potentially exposed individuals. However, in addition, when individuals who were not in the immunized ring, contract smallpox, significant protection is afforded by prior expansion and memory of CD4+ T helper cell clones, CD8+ cytotoxic T lymphocyte clones, and B cell immunoglobulin producing clones as the case might be. Such responses create a more rapid time frame for development of clinically protective responses frame to presentation of those same and other epitopes by the smallpox virus, than would be the case in individuals not immunized with the hybrids. The process of inducing responses to viral epitopes other than that in the immunizing Ii-Key/smallpox antigenic epitope hybrid, is referred to as epitope spreading.

Although vaccination is generally regarded to be the best defense against smallpox virus, the approved vaccines and some in development are not optimally safe or potent. The Ii-Key/smallpox MHC Class II epitope hybrid vaccines can be used either alone or together with other approaches, including whole virus preparations, DNA and RNA vaccines, inactivated whole virus, and virus-like particles. The Ii-Key/antigenic epitope hybrid vaccines revealed in this Disclosure can be used in conjunction with diluted whole virus preparations, e.g., Dryvax, in order to improve the major reaction rate typically observed with diluted preparations and allow for decreased rates of complications (Frey S E. N Engl J Med 2002 346:1265-75; Frey S E. N Engl J Med 2002 346:1275-80). In addition, Ii-Key/smallpox MHC Class II epitope hybrid vaccines can be used with attenuated virus strains that have been developed (Ankara MVA and Japanese strain LC16 m8) in order to augment their efficacy (Rosenthal S R. Emerg Infect Dis 2001 7:920-6; Henderson D A JAMA. 1999:281: 2127-39). Ii-Key/smallpox MHC Class II epitope hybrid vaccines can be used with DNA or RNA vaccines targeting gene products that are critical for viral pathogenicity and infectivity, for example, B5R and others (Phillpotts R J. Acta Virol 2000 44:151-6; Mathew E C. J Gen Virol 2001 82:1199-213).

Ii-Key/smallpox antigenic epitope hybrids offer potent and safe vaccines against smallpox. One favored example uses Ii-Key/antigenic epitope hybrids containing the Ii-Key LRMK (SEQ ID NO: 3) motif and an MHC Class II epitope of the smallpox B5R gene product gp42. Such a construct can be further enhanced with a linked or overlapping MHC Class I epitope(s) and/or antibody-determined epitope(s). By boosting the Th response >200 times to the MHC Class II epitope, Th1 cells are recruited to elicit potent CTL and humoral responses with immunological memory. Addition of a MHC Class I epitope to the hybrid affords antigenic epitope-specific enhancement of the cytotoxic T lymphocyte response. Addition of an antibody-recognized epitope to the hybrid affords antigenic epitope-specific enhancement of the antibody-determined response.

Smallpox gp42 is selected for several reasons. (1) Gene B5R encodes a 42 kD glycoprotein that is expressed throughout the course of infection and forms part of the envelope of the extracellular virus. (2) gp42 is required for the envelopment and egress of extracellular virus and virus virulence. (3) gp42-specific IgG neutralizing antibodies are correlated with protection against *orthopox* infection in humans (Phillpotts R J. Acta Virol 2000 44:151-6; Englestad M. Virology. 194:627-37; Mathew E C. J Gen Virol 2001 82:1199-213). In the course of routine experimentation to identify the biologically function and vaccine potential of additional proteins coded for or induced by the smallpox virus, additional candidates for the design, synthesis and use of Ii-Key/smallpox antigenic epitope hybrids will be targeted. The methods of this Disclosure can be applied without undue experimentation toward the development of additional Ii-Key/smallpox antigenic epitope hybrid vaccines. Other extracellular envelope proteins such as A33R, A34R, A36R, and A56R, can be used to produce Ii-Key/antigenic epitope hybrids.

In addition to the above vaccine methods, the Ii-Key/smallpox antigenic epitope hybrids can be used to enhance responses to DNA vaccines encoding B5R gp42. Such DNA vaccines can also be enhanced further by incorporating the Ii reverse gene construct in the same plasmid or delivery construct. Suppression of Ii protein expression allows for the presentation of endogenous gp42 epitopes. In the context of B5R DNA vaccination, targeted Ii-suppressed antigen presenting cells will present an increased repertoire of novel, perhaps cryptic, B5R epitopes.

This invention relates in part to the design of Ii-Key/Variola B5R protein antigenic epitope hybrids. The genes of the variola virus have been identified and sequenced principally by investigators in Russia (Shchelkunov S N. FEBS Lett. 1993 319:80-83; Shchelkunov S N. Virus Res. 1994 34:207-236; Shchelkunov S N. Virus Genes 1995: 9:231-245; Shchelkunov S N. Virus Res. 1996 40:169-183). The sequence of Variola virus B5R protein (g510228) is presented in Table 18.1. Predicted MHC Class II-presented epitopes of the B5R protein are presented in Table 18.2. Table 18.3 lists Ii-Key/variola B5R protein epitope hybrids containing some of the MHC Class II-presented epitopes of Table 18.2. Predicted MHC Class I-presented epitopes of variola B5R protein are presented in Table 18.4. Table 18.5 lists Ii-Key/MHC Class II-presented/MHC Class I-presented B5R hybrids.

TABLE 18.1

Deduced amino acid sequence of the B5R protein of the variola virus. (SEQ ID NO: 733)

```
  1 mktisvvtll cvlpavvyst ctvptmnnak ltstetsfnd kqkvtftcds 51 gyysldpnav cetdkwkyen pckkmctvsd yvselynkpl yevnaiitli 101 ckdetkyfrc eekngntswn dtvtcpnaec qslqldhgsc qpvkekysfg 151 ehitincdvg yevigasyit ctanswnvip scqqkcdips lsnglisgst 201 fsiggvihls cksgfiltgs psstcidgkw npvlpicirs neefdpvedg 251 pddetdlskl skdvvqyeqe iesleatyhi iivaltimgv iflisvivlv 301 cscnknndqy kfhklll
```

TABLE 18.2

Predicted MHC Class II-presented epitopes of the B5R protein.

| PEPTIDE | Pos. | Sequence | Ii-Key | Score | Allele | SEQ ID NO: |
|---|---|---|---|---|---|---|
| 18.2.1 | 289 | VIFLISVIV | 6 | 2.2 | 01 | 734 |
| 18.2.2 | 290 | IFLISVIVL | 7 | 3.8 | 03, 07, 15 | 735 |
| 18.2.3 | 291 | FLISVIVLV | 8 | 6.3 | 07 | 736 |
| 18.2.4 | 51 | YYSLDPNAV | 4 | 2.2 | 01 | 737 |
| 18.2.5 | 229 | WNPVLPICI | 13 | 2.1 | 01, 07 | 738 |
| 18.2.6 | 206 | IHLSCKSGF | 4 | 4.8 | 03 | 739 |
| 18.2.7 | 281 | IVALTIMGV | 0 | 4.2 | 03, 11, 13, 15 | 740 |
| 18.2.8 | 279 | IIIVALTIM | 0 | 3.8 | 03 | 741 |
| 18.2.9 | 214 | FILTGSPSS | 0 | 3.8 | 04 | 742 |
| 18.2.10 | 175 | WNVIPSCQQ | 0 | 3.6 | 04 | 743 |
| 18.2.11 | 52 | YSLDPNAVC | 5 | 3.4 | 04, 08, 11 | 744 |
| 18.2.12 | 277 | YHIIIVALT | 11 | 3.5 | 08, 11 | 745 |
| 18.2.13 | 284 | LTIMGVIFL | 0 | 2.3 | 08, 07, 13, 15 | 746 |
| 18.2.14 | 6 | VTLLCVLPA | 0 | 3.8 | 06, 01, 13 | 747 |
| 18.2.15 | 84 | LYNKPLYEV | 6 | 2.5 | 14 | 748 |
| 18.2.16 | 289 | VIFLISVIV | 6 | 3.6 | 15 | 749 |

Pos. is the residue position in the primary sequence of the first amino acid in the antigenic epitope. Sequence is the amino acid sequence of the predicted MHC Class II-presented epitope. When a given sequence is predicted to be presented by multiple HLA-DR alleles, the first residue position of each sequence is indicated. Score is the score reported by the ProPred program, for the relative likelihood of being presented by the first HLA-DR allele listed. The respective alleles are in each case the HLA-DRB*_01 allele. Ii-Key is the number of residue positions intervening between an Ii-Key motif and the first residue of the antigenic epitope.

TABLE 18.3

Ii-Key/variola B5R epitope hybrids containing some of the MHC Class II-presented epitopes of Table 18.2.

| PEPTIDE | Pos. | Sequence | SEQ ID NO: |
|---|---|---|---|
| 18.3.1 | 289, 290, 291 | Ac-LRMK-ava-VIFLISVIVLV-NH$_2$ | 750 |
| 18.3.2 | 16 | Ac-LRMK-ava-YYSLDPNAV-NH$_2$ | 751 |
| 18.3.3 | 229 | Ac-LRMK-ava-WNPVLPICI-NH$_2$ | 752 |
| 18.3.4 | 206 | Ac-LRMK-ava-IHLSCKSGF-NH$_2$ | 753 |
| 18.3.5 | 279, 281 | Ac-LRMK-ava-IIIVALTIMGV-NH$_2$ | 754 |
| 18.3.6 | 214 | Ac-LRMK-ava-FILTGSPSS-NH$_2$ | 755 |
| 18.3.7 | 175 | Ac-LRMK-ava-WNVIPSCQQ-NH$_2$ | 756 |
| 18.3.8 | 52 | Ac-LRMK-ava-YHIIIVALT-NH$_2$ | 757 |
| 18.3.9 | 277 | Ac-LRMK-ava-YHIIIVALT-NH$_2$ | 758 |
| 18.3.10 | 284 | Ac-LRMK-ava-LTIMGVIFL-NH$_2$ | 759 |
| 18.3.11 | 6 | Ac-LRMK-ava-VTLLCVLPA-NH$_2$ | 760 |
| 18.3.12 | 84 | Ac-LRMK-ava-LYNKPLYEV-NH$_2$ | 761 |
| 18.3.13 | 289 | Ac-LRMK-ava-VIFLISVIV-NH$_2$ | 762 |

Pos. is the residue position in the primary sequence of the first amino acid in the antigenic epitope. In cases of closely overlapping predictions, the first residue position is given for each predicted epitope. Sequence is the amino acid sequence of a hybrid peptide containing a MHC Class II epitope of Table 18.2.

TABLE 18.4

Predicted MHC Class I-presented epitopes of variola B5R protein.

| PEPTIDE | Pos. | Sequence | Score | SEQ ID NO: |
|---|---|---|---|---|
| 18.4.1 | 292 | FLISVIVLV | 736 | 763 |
| 18.4.2 | 8 | TLLCVLPAV | 592 | 764 |
| 18.4.3 | 74 | KMCTVSDYV | 474 | 765 |
| 18.4.4 | 286 | TIMGVIFLI | 71 | 766 |
| 18.4.5 | 9 | LLCVLPAVV | 48 | 767 |
| 18.4.6 | 12 | VLPAVVYST | 29 | 768 |
| 18.4.7 | 290 | VIFLISVIV | 25 | 769 |
| 18.4.8 | 282 | IVALTIMGV | 24 | 770 |
| 18.4.9 | 77 | TVSDYVSEL | 18 | 771 |
| 18.4.10 | 195 | LISGSTFSI | 14 | 772 |

Pos. is the residue position in the primary sequence of the first amino acid in the antigenic epitope predicted for HLA-A201 (Parker K C. J. Immunol. 152:163-175). Sequence is the amino acid sequence of the predicted MHC Class I-presented epitope. Score is the $T_{1/2}$ of disassociation of a peptide containing this subsequence (Tsang K Y. J Natl Cancer Inst. 1995 87:982-90). The MHC Class I-presented epitopes of this Table were predicted with the use of the online program (accessed via: bimas.dcrt.nih.gov/molbio/hla_bind/).

TABLE 18.5

Ii-Key/MHC Class II-presented/MHC Class I-presented B5R hybrids.

| PEPTIDE | Pos. | Sequence | SEQ ID NO: |
|---|---|---|---|
| 18.5.1 | II: 289, 290, 291<br>I: 290, 292 | Ac-LRMK-ava-VIFLISVIVLV-NH$_2$ | 773 |
| 18.5.2 | II: 286, 289, 290, 291<br>I: 290, 292 | Ac-LRMK-ava-TIMGVIFLISVIVLV-NH$_2$ | 774 |
| 18.5.3 | II: 277, 279, 284 NH$_2$<br>I: 286 | Ac-LRMK-ava-YHIIVALTIMGVIFLI- | 775 |
| 18.5.4 | II: 6<br>I: 8, 9 | Ac-LRMK-ava-VTLLCVLPAVV-NH$_2$ | 776 |

Pos. is the residue position in the primary sequence of the first amino acid in either the MHC class II-presented antigenic epitope (II:) or the MHC class I-presented antigenic epitope (I:). Sequence is the amino acid sequence of a hybrid peptide containing a MHC Class II-presented epitope of Table 18.2 and a MHC Class I-presented epitope of Table 18.5.

Example 19

Ii-Key/Ebola Virus Antigenic Epitope Hybrids

Being among the most virulent infectious agents known, the Filoviruses, which include the Marburg and Ebola viruses, are classified at biosafety level 4 due to the extreme pathogenicity of certain strains and the absence of a protective vaccine or effective antiviral drug (Wilson J A. Cell Mol Life Sci. 2001 58:1826-41). Ebola virus causes a hemorrhagic fever, a severe, mostly fatal disease in humans and nonhuman primates, recognized in sporadic clusters since 1976. The natural reservoir for Ebola virus is an animal native to Africa (Peters C J. J Infect Dis. 1999 179(Suppl 1): ix-xvi). The strain Ebola-Reston was isolated in the U.S. from imported cynomologous monkeys. Public concern over Ebola virus in non-African countries is derived from potential for spread of the viruses by international commerce, jet travel, and bioterrorism.

Clusters of Ebola virus infections in humans appear to depend upon the first patient contacting an infected animal. After an index case-patient is infected, transmission occurs among humans by direct contact with (1) blood and/or secretions of an infected person and (2) objects, such as needles and syringes, that have been contaminated with infected secretions. All Ebola viruses can be transmitted in aerosols under research conditions.

Within a few days of becoming infected with Ebola virus, most patients have high fever, headache, myalgia, abdominal pain, fatigue and diarrhea. Some patients have sore throat, hiccups, rash, red eyes, and bloody emesis and diarrhea. Within a week of becoming infected with Ebola virus, most patients have chest pain, shock, and death, while some experience blindness and bleeding (Gear H S. Reviews of Infectious Diseases. 1989 11(suppl 4):5777-5782). Why some patients recover from Ebola hemorrhagic fever is not understood, although those who do develop a significant immune response to the virus.

Treatment of patients with Ebola hemorrhagic fever is supportive, consisting primarily in balancing the patient's fluids and electrolytes, maintaining oxygenation and blood pressure, and treating accompanying infections (CDC. Management of patients with suspected viral hemorrhagic fever. Morbidity and Mortality Weekly Report. 1988 37(suppl 3):1-16).

Ebola virus has caused a series of devastating hemorrhagic fever outbreaks, the first being reported in 1976 in Yambuku, Zaire where 318 people contracted Ebola hemorrhagic fever, with 88% dying. Disease spread by close personal contact and contaminated needles and syringes in hospitals and clinics. Also in 1976, in the Sudan (Nzara and Maridi), 284 people contracted Ebola hemorrhagic fever, with 53% dying and the disease being spread mainly through close personal contacts in hospitals (Bowen E T W. Lancet 1977 1:571-3). In 1979, there was a recurrent outbreak in the Sudan, with 34 patients and 65% dying (Baron R C. Bull WHO 1983 62:997-1003). In 1994, 44 people in Gabon (Minkebe, Makokou, and gold-mining camps deep within the rain forest) developed Ebola hemorrhagic fever, with 63% dying. This outbreak was thought initially to be yellow fever, however in 1995 it was identified to be Ebola hemorrhagic fever (Georges A J. J Infect Dis. 1999 179 Suppl 1:S65-75). In 1995, 315 people in Kikwit, Democratic Republic of the Congo (formerly Zaire) contracted Ebola hemorrhagic fever, with 81% dying (Le Geuenno B. Lancet. 1995 345:1271-4). This outbreak was traced to an index case-patient who worked in a forest adjoining the city; the outbreak spread through families and hospitals. In 1996 in Mayibout, Gabon, 37 people developed Ebola hemorrhagic fever, with 57% dying. A dead, infected chimpanzee, eaten by 19 people in the forest, initiated this outbreak. In the same year in Boue, Gabon, 60 patients were infected with Ebola-Zaire, with 75% dying. The index case-patient was a hunter who lived in a forest camp; a dead, infected chimpanzee was found nearby. Finally, in 2000 and 2001 in Uganda (Gulu, Masindi, and Mbarara) 425 people contracted Ebola hemorrhagic fever, with 53% dying. The three most important risk factors associated with infection were: attending funerals of Ebola hemorrhagic fever case-patients, contacting case-patients in one's family, and providing medical care to Ebola case-patients without using adequate personal protective measures and practices (CDC: SPB: Disease Information Fact Sheets: Ebola: Case Table 2001).

Because the natural reservoir for Ebola virus is undetermined and human-to-human spread is documented, vaccines appear to be the best method to limit infectious spread (Nabel G L. Trans Am Clin Climatol Assoc. 2001 112:79-84). Antibodies isolated from serums of patients recovered from the 1995 Ebola infection Kikwit, Democratic Republic of the Congo, using recombinant phage display adsorption techniques, neutralized Ebola infectivity (Maruyama T. J Virol. 1999 73:6024-30). This finding coupled with the fact that dying patients do not mount an immunologically potent response offers hope that preventative vaccines will be effective. While no such vaccines are available, several vaccine approaches are under development including DNA and RNA replicon vaccines encoding Ebola viral proteins NP (major nucleocapsid protein), VP35 (phosphoprotein), VP40 (membrane-associated matrix protein), GP (transmembrane glycoprotein), sGP (secreted glycoprotein), VP30 (ribonucleoprotein associated—minor), and VP24 (membrane-associated protein—minor) (WO 99/32147; WO 00/00617; Wilson J A. Virology. 2001 286:384-90; Pushko P. Vaccine. 2000 19:142-53; and Vanderzanden L. Virology. 1998 246:134-44).

The NIAID plans to initiate clinical trials with an adenoviral vaccine encoding genes for Ebola glycoprotein and nucleoprotein within 2 years. This vaccine induces protective immunity in non-human primate studies (Sullivan N J, Nature 2000 408:605-9; Cheary M, Dutch Firm to Develop Ebola Vaccine with US, Reuters May 16, 2002). Another vaccine is being developed with Ebola-like particles which are nonreplicating due to the absence of Ebola genetic materials, but possessing proteins contained on the inner and outer membranes (UASAMRIID, Bavari S, *J Exp Med*. 2002 195:1-11). A variety of vaccine strategies that protected mice and guinea pigs from lethal challenges with Ebola virus have been tested in non-human primates including: RNA replicon particles derived from attenuated strain of VEE expressing Ebola glycoprotein and nucleoprotein, recombinant Vaccinia virus expressing Ebola glycoprotein, liposomes containing lipid A and inactivated Ebola virus, and a concentrated inactivated whole Ebola virion preparation (Geisbert T W. Emerg Infect Dis. 2002 8:503-7; Pushko P. J Virol. 2001 75:11677-85; and Pushko P. Vaccine. 2000 19:142-53). Unfortunately, none of these approaches were successful in protecting non-human primates from lethal Ebola virus challenge.

Vaccinating nice with Venezuelan equine encephalitis (VEE) virus replicons encoding Ebola virus nucleoprotein induced both antibodies and MHC Class I-restricted cytotoxic T-cells to an 11 amino-acid, Ebola virus NP(43-53). Passive transfer of polyclonal antibodies did not protect mice from a lethal challenge with Ebola virus; however, adoptive transfer of Ebola virus NP-specific CTLs did protect mice from an Ebola virus lethal challenge (Wilson J A. J Virol. 2001 75:2660-4). Protective recombinant antibodies have been identified to 5 unique epitopes of Ebola glycoprotein, with one of the epitopes being conserved among all strains known to be pathogenic for humans (Wilson J A. Science. 2000 287:1664-6). Some of those monoclonal antibodies were also therapeutically effective upon administration to mice 2 days following a lethal challenge with Ebola virus. These data support view that both antibody and cell-mediated responses are important for protection against Ebola virus and therefore vaccine strategies designed to promote both antibody and CTL responses are preferred.

Although vaccines are generally regarded to be the best defense against Ebola virus, vaccines in development have not been demonstrated to be optimally protective. In the case of DNA vaccines, whether presented in plasmids, in viral particles, or in another formulation, some of these developmental issues include: 1) delivery vector of formulation (cDNA as naked DNA, or in plasmid or bacterial vectors, or with lipid or other transfecting carrier, or on gold particles or in PLG particles), 2) route of administration (skin, mucosal (GI or respiratory tracts), or muscle) 3) choice or one or multiple EBOLA genes and promoters for those genes, 4) genetic or protein adjuvants for cytokines or the products of this Disclosure, 5) dose, dosage schedule and other pharmacokinetic and pharmacodynamic considerations.

This example presents the design of a potent and relatively safe vaccine against Ebola virus VP24. The deduced amino acid sequence of Ebola VP24 is from Gen Bank g16751326 (Leroy E M. J Gen Virol 2002 83: 67-73). The strain of this protein was the one present in deceased, surviving and asymptomatically infected individuals during the 1996 outbreak in Gabon. Sequences of GP, NP, VP24 and VP40 genes were obtained with comparative studies and phylogenetic characterization.

Although experimentally determined MHC Class II epitopes are a more expeditious route to the construction of Ii-Key/antigenic epitope hybrids, such can be made with epitopes predicted with algorithms. Such epitopes predicted to be presented by multiple HLA-DR alleles are presented in Table 2. Ii-Key/Ebola MHC Class II antigenic epitope hybrids containing the Ii-Key LRMK (SEQ ID NO: 3) motif and single or significantly overlapping MHC Class II epitopes of VP24 are presented in Table 3. Such hybrids can be constructed with the fusion of MHC Class I-presented epitopes. Again in the absence of experimentally determined MHC Class I-presented epitopes, algorithm-predicted epitopes have been identified (Table 4). Such epitopes can be fused into Ii-Key/MHC Class II antigenic epitope hybrids, preferably when the highest degree in overlap of the MHC Class II and MHC Class I sequences are obtained. Examples of such products are presented in Table 5. When experimentally determined, antibody-recognized determinants have been identified experimentally or by prediction, additional hybrids composed of Ii-Key/MHC Class II-presented antigenic epitopes and such antibody-recognized epitopes can be designed by the methods presented herein without undue experimentation. Furthermore, the methods applied to the design and testing of Ii-Key/antigenic epitope hybrids composed of epitopes form VP24 can also be applied to similar vaccine hybrids with epitopes form other Ebola virus proteins, such as GP, NP, sGP, VP24, VP30, VP35 and VP40. The experimental validation of these hybrids can be accomplished in vaccination studies of mice by routine methods (Wilson J A. Virology. 2001 286:384-90). Among additional objective in such murine studies is the testing of the concept that presentation of a MHC Class II-presented epitope in and Ii-Key/antigenic epitope hybrid will lead to presentation by a low responder allele, functionally converting the presentation to a promiscuous epitope, as discussed in the Background of the Invention. In the study of Wilson J A and colleagues, although immunization with VP24 was capable of stimulating a potent immune response in a BALB/c model, VP24 induced no protective effects in the C57BL/6 strain (Wilson J A. J Virol. 2001 75:2660-4). Thus, immunization of both BALB/c and C57BL/6 strains of mice with a MHC Class II-presented VP24 epitope will yield comparable immune responses as measure by antibody titers to the epitope in ELISAs, by induction of CD4+/IFNγ+ cells in the two-color FACS analysis, and by induction of CD4+/IFNγ+ cells in ELISPOT assays. Furthermore C57BL/6 mice will be protected against a lethal challenge against VEE.

The sequence of Ebola virus membrane associated protein VP24 (Gen Bank # g16751326; Leroy E M. J Gen Virol 2002 83: 67-73) is presented in Table 1. Predicted MHC Class II-presented epitopes are presented in Table 2. Ii-Key/Ebola virus VP24 MHC class II epitope hybrids are presented in Table 3. Predicted Ebola virus VP24 MHC Class I-presented epitopes are presented in Table 4. Ii-Key/Ebola VP 24 MHC Class II-predicted epitope/Ebola VP 24 MHC Class I-predicted epitope hybrids are presented in Table 5.

TABLE 19.1

Sequence of Ebola virus membrane associated protein VP24 (SEQ ID NO: 777)

```
  1 makatgrynl ispkkdlekg vvlsdlcnfl vsqtiqgwkv ywagiefdvt
 51 hkgmallhrl ktndfapaws mtrnlfphlf qnpnstiesp lwalrvilaa
101 giqdqlidqs lieplagalg lisdwllttn tnhfnmrtqr vkeqlslkml
151 slirsnilkf inkldalhvv nyngllssie igtqnhtiii trtnmgflve
201 lqepdksamn rkkpgpakfs llhestlkaf tqgsstrmqs lilefnssla i
```

TABLE 19.2

Predicted MHC Class II-presented epitopes.

| PEPTIDE | POS. | Sequence | Score | DR | Ii-Key | SEQ ID NO: |
|---|---|---|---|---|---|---|
| 19.2.1 | 93 | LRVILAAGI | 2.90 | 0101 | 11 | 778 |
| 19.2.2 | 20 | VVLSDLCNF | 4.90 | 0301 | 3 | 779 |
| 19.2.3 | 151 | LIRSNILKF | 4.30 | 0301 | 5 | 780 |
| 19.2.4 | 146 | LKMLSLIRS | 4.20 | 0301 | 7 | 781 |
| 19.2.5 | 157 | LKFINKLDA | 3.90 | 0301 | 5 | 782 |
| 19.2.6 | 135 | MTRQRVKEQ | 3.60 | 0306 | 0 | 783 |
| 19.2.7 | 169 | VNYNGLLSS | 3.40 | 0306 | 5 | 784 |
| 19.2.8 | 220 | LLHESTLKA | 4.30 | 0401 | 0 | 785 |
| 19.2.9 | 124 | WLLTTNTNH | 3.98 | 0401 | 0 | 786 |
| 19.2.10 | 187 | IIITRTNMG | 3.80 | 0401 | 0 | 787 |
| 19.2.11 | 28 | FLVSQTIQG | 3.28 | 0401 | 4 | 788 |
| 19.2.12 | 34 | IQGWKVYWA | 4.80 | 0402 | 11 | 789 |

The epitopes of this Table were chosen by the following procedure. The sequence of EBOLA VP24 (GenBank g16751326) was subjected to HLA-DR epitope screening with the ProPred program. The 4 highest scoring epitopes of each allele was identified. Among that set, the first 14 unique epitopes were reported here, with the HLA-DR allele of their first occurrence. Many epitopes that are reported here, were in fact scored by the sequence algorithms of several alleles. Pos. is the amino acid residue position of the first amino acid of the epitope. Score is the score calculated by the ProPred program. Ii-Key is the number of amino acid residues intervening between the first amino acid of the epitope and N-terminally, a 5-amino acid-motif containing at least two amino acids of the group LIVFM (SEQ ID NO: 790) and at least one amino acid of the group HKR.

TABLE 19.3

Ii-Key/Ebola virus VP24 MHC class II epitope hybrids.

| PEPTIDE | POS. | Sequence | SEQ ID NO: |
|---|---|---|---|
| 19.3.1 | 20 | Ac-LRMK-VVLSDLCNF-NH$_2$ | 791 |
| 19.3.2 | 28 | Ac-LRMK-FLVSQTIQG-NH$_2$ | 792 |
| 19.3.3 | 34 | Ac-LRMK-IQGWKVYWA-NH$_2$ | 793 |
| 19.3.4 | 28; 34 | Ac-LRMK-FLVSQTIQGWKVYWA-NH$_2$ | 794 |
| 19.3.5 | 146 | Ac-LRMK-LKMLSLIRS-NH$_2$ | 795 |
| 19.3.6 | 151 | Ac-LRMK-LIRSNILKF-NH$_2$ | 796 |
| 19.3.7 | 157 | Ac-LRMK-LKFINKLDA-NH$_2$ | 797 |
| 19.3.8 | 146; 151 | Ac-LRMK-LKMLSLIRSNILKF-NH$_2$ | 798 |
| 19.3.9 | 169 | Ac-LRMK-VNYNGLLSS-NH$_2$ | 799 |
| 19.3.10 | 220 | Ac-LRMK-LLHESTLKA-NH$_2$ | 800 |
| 19.3.11 |  | Ac-LRMK-NH$_2$ | 801 |

TABLE 19.4

Predicted Ebola virus VP24 MHC Class I-presented epitopes.

| PEPTIDE | POS. | Sequence | Score | SEQ ID NO: |
|---|---|---|---|---|
| 19.4.1 | 22 | VLSDLCNFL | 819 | 802 |
| 19.4.2 | 241 | LILEFNSSL | 288 | 803 |
| 19.4.3 | 156 | NILKFINKL | 95 | 804 |
| 19.4.4 | 118 | ALGLISDWL | 58 | 805 |
| 19.4.5 | 32 | SQTIQGWKV | 53 | 806 |
| 19.4.6 | 144 | QLSLKMLSL | 49 | 807 |
| 19.4.7 | 110 | SLIEPLAGA | 47 | 808 |
| 19.4.8 | 221 | LLHESTLKA | 35 | 809 |
| 19.4.9 | 9 | NLISPKKDL | 21 | 810 |
| 19.4.10 | 149 | MLSLIRSNI | 18 | 811 |
| 19.4.11 | 121 | LISDWLLTT | 16 | 812 |
| 19.4.12 | 120 | GLISDWLLT | 13 | 813 |

These HLA*A201 epitopes were scored with a computer-assisted algorithm (Parker K C. J. Immunol. 152:163-175).

TABLE 19.5

Ii-Key/Ebola VP 24 MHC Class II-predicted epitope/Ebola VP 24 MHC Class I-predicted epitope hybrids.

| PEPTIDE | POS. | Sequence | SEQ ID NO: |
|---|---|---|---|
| 19.5.1 | II: 20; I: 22 | Ac-LRMK-VVLSDLCNFL-NH₂ | 814 |
| 19.5.2 | II: 28; I: 22 | Ac-LRMK-VLSDLCNFLVSQTIQG-NH₂ | 815 |
| 19.5.3 | II: 124; I: 120, 121 | Ac-LRMK-GLISDWLLTTNTNH-NH₂ | 816 |
| 19.5.4 | II: 146; I: 144 | Ac-LRMK-QLSLKMLSIRS-NH₂ | 817 |
| 19.5.5 | II: 146; I: 146, 149 | Ac-LRMK-QLSLKMLSLIRSNI-NH₂ | 818 |
| 19.5.6 | II: 157; I: 156 | Ac-LRMK-NILKFINKLDA-NH₂ | 819 |
| 19.5.7 | II: 151, 157; I: 149, 156 | Ac-LRMK-LIRSNILKFINKLDA-NH₂ | 820 |
| 19.5.8 | II: 220; I: 221 | Ac-LRMK-LLHESTLKA-NH₂ | 821 |

Example 20

Ii-Key/Myelin Basic Protein MHC Class II-Presented Epitope Hybrids

In another aspect, induction of suppressor T-immunoregulatory cells specific for autoantigens, such as myelin basic protein in multiple sclerosis and collagen in arthritis, is a well-investigated and promising strategy for the control of these human autoimmune diseases. Administering peptide from myelin basic protein or collagen by oral or respiratory routes decreases antibodies to these proteins, suppresses cellular immune responses, and delays or inhibits development of experimental allergic encephalitis or collagen arthritis in animal models. In addition, certain hMBP peptides, which bind to and neutralize anti-MBP antibodies, have been tested in the clinic. MBP75-85 peptide administered intrathecally neutralized anti-myelin basic protein antibodies; intravenous administration of this peptide resulted in decreased titers of free and bound anti-myelin basic protein levels through an active immunotolerance-inducing mechanism. Various peptides ranging from 10 amino acids to 25 amino acids within the MBP sequence of 61 to 106 demonstrated this activity. Such peptides and methods of their use, which can be adapted for novel therapies with Ii-Key/antigenic epitope hybrids, have been described in U.S. Pat. No. 5,858,364: H L Weiner and D A Hafler, Jan. 12, 1999—Pharmaceutical dosage form for treatment of multiple sclerosis; and U.S. Pat. No. 5,571,499: D A Hafler and H L Weiner, Nov. 5, 1996—Treatment of autoimmune disease by aerosol administration of autoantigens and U.S. Pat. No. 6,258,781: K G Warren and I Catz, Jul. 10, 2001—Peptide specificity of anti-myelin basic protein and the administration of myelin basic protein peptides to multiple sclerosis patients, the disclosures of which are incorporated herein by reference. These results have been considered in detail below with respect to the incorporation of such epitopes in to Ii-Key/antigenic epitope hybrids to increase the potency, safety, memory and Th subset preference of such therapeutic effects.

Multiple sclerosis (MS), a demyelinating apparently autoimmune disease of the central nervous system associated with inflammation and gliosis, demonstrates T lymphocytes and autoantibodies directed to myelin proteins. Immunosuppressive therapies of multiple sclerosis can be developed with peptide epitopes from several myelin proteins. Such epitopes incorporated into Ii-Key/antigenic epitope hybrids can be tested in experimental allergic encephalitis, the animal model of multiple sclerosis. These proteins include myelin basic protein (MBP), proteolipid protein (PLP), myelin oligodendrocyte glycoprotein (MOG), and myelin-associated oligodendrocyte basic protein (MOBP) (Zamvill S S. Nature. 1986 324:258-60; Kono D H. J Exp Med. 1988 168:213-27; Madsen L S. Nat Genet. 1999 23:343-7; Tuohy V K. J Immunol. 1989 142:1523-7; Greer J M. J Immunol. 1992 149:783-8; Mendel I. Eur J Immunol. 1995 25:1951-9). The MHC Class II-presented epitopes of particular therapeutic interest are summarized here and then the experimental data supporting their use in Ii-Key/antigenic epitope hybrids are reviewed in detail in part to consider methods for their use in both pre-clinical animal models and in the development and use of clinical therapies based on such studies. MBP85-99 is immunodominant in humans, and several epitopes in this region induce EAE in mice (MBP87-98, MBP91-104, and MBP84-102). PLP139-151 and PLP178-191 are encephalitogenic epitopes in mice; when whole protein is used to immunize mice, lymph node cells respond to both of these epitopes indicating they are co-dominant. The encephalitogenic potential of several predicted T-cell epitopes from MOG (1-21, 35-55, 67-87, 104-117, and 202-218) were tested in mice; only MOG35-55 induced specific T-cell responses and EAE. This epitope stimulates specific T cell responses to MOG40-55 and T cell lines reactive to MOG40-55 were encephalitogenic upon transfer to syngeneic mice. MOBP37-60 is encephalitogenic in mice. Peripheral blood lymphocytes from a patient with MS mount a proliferative response to MOBP, especially MOBP21-39. The use of a DNA plasmid encoding multiple encephalitogenic epitopes derived from MBP (7-50, 83-106, and 142-168), MOG (1-25, 32-58, and 63-97), and PLP (30-60, 84-116, and 139-155) was shown to protect mice from developing EAE induced by PLP139-151.

Ii-Key/antigenic epitope hybrids comprising MHC Class II-presented epitopes derived from autoantigenic peptides from MBP, PLP, MOG, and MOBP, as described above, will have many preferred characteristics as immunopharmacological therapeutics. The useful effects of such Ii-Key/antigenic epitope hybrids in the treatment of MS, whether used as peptides or DNA vaccines include the following: (1) more rapid and potent immunosuppressive responses, (2) longer-duration of immunosuppressive responses and memory for later challenges, (3) decreased incidence of neo-reactivities as a result of intra- or intermolecular spread of autoimmunity, (4) greater breadth of response as a result of more potent presentation of epitopes on otherwise low-responding alleles, and (5) greater protection against the development, or slowing or reversal of, clinical manifestations of disease.

Warren, Catz and colleagues have demonstrated that human myelin basic protein (hMBP) peptide-based tolerance induction might be an effective antigen-specific immunotherapy for MS (Warren K G. J Neurol Sci. 1995 133:85-94; Warren K G. J Neurol Sci. 1997 148:67-78; Warren K G. J Neurol Sci. 1997 152:31-8). Tolerance to myelin basic protein (MBP) was examined in a Phase I clinical trial in MS patients with chronic progressive disease using hMPB peptide P85VVHFFKNIVTP96 (SEQ ID NO: 822) that is immunodominant for MBP-specific T cells and B cells. Tolerance induction was monitored by titers of MBP-specific autoantibodies in the CSF. Intravenous but not intrathecal or subcutaneous injection induced tolerance to MBP. Four kinetic patterns of response were observed in 41 patients (Warren K G. Mult Scler. 2000 6:300-11): Group A (15 patients) illustrated prolonged anti-BMP suppression into the normal range; Group B (10 patients) illustrated significant anti-MBP suppression into the normal range for shorter durations; Group C (eight patients) showed significant CSF anti-MBP suppression after the initial injection but lost the ability to suppress the autoantibody titer following subsequent injections; and Group D (eight patients) failed to show significant CSF anti-MBP suppression. In the control group, anti-MBP antibodies remained persistently elevated over the 2-year period. Tolerance duration depended on MHC Class II haplotypes of patients; tolerance was long-lived in all patients with disease-associated HLA-DR2. No neurological or systemic side effects were observed, regardless of the route of peptide administration.

Lees and colleagues identified several encephalitogenic determinants of myelin proteolipid protein active in SJL mice (Tuohy V K. J Immunol. 1989 142:1523-7; Greer J M. J Immunol. 1992 149:783-8). Immunization with PLP, the major protein constituent of central nervous system myelin, induces an acute form of EAE SJL/J (H-2s) mice. Immunization with PL139-154(HCLGKWLGHPDKFVGI) (SEQ ID NO: 823) induced severe clinical and histological EAE in 3 of 20 mice. In addition, PLP(178-191) also induced EAE in these mice. Two CD4+, peptide-specific, I-A(s)-restricted T cell lines, selected by stimulation of lymph node cells with either PLP 178-191 or 139-151, were each encephalitogenic in naive syngeneic mice.

Ben-Nun and colleagues tested several peptides from pMOG, finding that a myelin oligodendrocyte glycoprotein peptide induces typical chronic experimental autoimmune encephalomyelitis in H-2b mice (Mendel I. Eur J Immunol. 1995 25:1951-9; Kaye J F. J Neuroimmunol. 2000 102:189-98). This group also tested the hypothesis that multiple potentially pathogenic antimyelin T cell reactivities could be inhibited by tolerogenic administration of an artificial "multiantigen/multiepitope" protein (Zhong M C. J Clin Invest. 2002 110:81-90). A synthetic gene was constructed to encode selected disease-relevant epitopes of myelin basic protein (MBP), proteolipid protein (PLP), and myelin oligodendrocyte glycoprotein (MOG). Systemic administration of hmTAP not only suppressed and treated experimental autoimmune encephalomyelitis (EAE) initiated by autoreactivity to a PLP epitope, but also abrogated complex EAE transferred by multispecific line T cells reactive against encephalitogenic epitopes of MBP, PLP, and MOG. In addition Oldstone and colleagues identified the MOBP37-60 epitope, which induced experimental allergic encephalomyelitis in mice with a severe clinical course (Holz A. J Immunol. 2000 164:1103-9). Also PBL from patients with relapsing/remitting multiple sclerosis mount a proliferative response to human MOBP, especially at amino acids 21-39.

Anti-myelin antibodies can be found in some patients without MS (Warren K G. Eur Neurol. 1999 42:95-104). Wucherpfenning, Catz, Warren and colleagues affinity-purified MBP autoantibodies from central nervous system lesions of 11 postmortem cases (Wucherpfennig K W. J Clin Invest. 1997 100:1114-22). The MBP(83-97) peptide was immunodominant in all cases since it inhibited autoantibody binding to MBP >95%. Residues contributing to autoantibody binding were located in a 10-amino acid segment (V86-T95) that also contained the MHC/T cell receptor contact residues of the T cell epitope. In the epitope center, the same residues were important for antibody binding and T cell recognition.

Ii-Key Hybrids comprising MBP82-98 epitopes will increase the duration of anti-MBP suppressive responses, increase the proportion of patients developing sustained anti-MBP suppressive responses, increase the magnitude of the anti-MBP suppressive response, and decrease the number and frequency of doses needed to induce clinically effective anti-MBP suppressive responses. Because epitope charging with Ii-Key Hybrids is much greater than epitope alone, Ii-Key/MBP (85-96) Hybrids will facilitate binding to a greater repertoire of HLA DR alleles, thereby increasing the proportion of patients responding to treatment. Ii-Key/MBP (MBP85-96) Hybrids will also trigger a cell-mediated suppressive immune response to the MBP85-96 epitope. Ii-Key Hybrids comprising this and/or other MHC Class II epitopes either alone, or in combination with MHC Class I or B-cell antibody recognized determinants (arranged linearly in tandem to—or imbedded within—the MHC Class II epitope) will also induce enhanced immunosuppressive responses the MBP that provide for clinically significant therapeutics for patients with multiple sclerosis.

Selected preclinical studies reveal mechanisms and specific structural (chemical) data that are useful in determining optimal epitope structure and methods of use of Ii-Key/antigenic epitope hybrids in the treatment of MS. Krogsgaard M, Wucherpfennig K W, Fugger L and colleagues used phage display technology to select HLA-DR2-peptide-specific antibodies from HLA-DR2-transgenic mice immunized with HLA-DR2 molecules complexed with MBP 85-99 (Krogsgaard M. J Exp Med. 2000 191:1395-412). The MK16-selected antibodies recognized only complexes of DR2 and MBP and recognized intra- and extracellular HLA-DR2-MBP peptide complexes when antigen-presenting cells (APCs) had been pulsed with recombinant MBP. MK16 antibodies inhibited interleukin 2 secretion by two transfectants that expressed human MBP-specific T cell receptors. Analysis of the structural requirement for MK16 binding demonstrated that the two major HLA-DR2 anchor residues of MBP 85-99 and the COOH-terminal part of the peptide, in particular residues Val-96, Pro-98, and Arg-99, were important for binding. Based on these results, the antibody was used to determine if the HLA-DR2-MBP peptide complex was presented in MS lesions. The antibody stained APCs in MS lesions, in particular microglia/macrophages but also in some cases hypertrophic astrocytes. Staining of APCs was only observed in MS cases with the HLA-DR2 haplotype but not in cases with other haplotypes. These results demonstrated that HLA-DR2 molecules in MS lesions present a myelin-derived self-peptide and indicate that microglia/macrophages rather than astrocytes are the predominant APCs in these lesions.

Fugger and colleagues expressed in transgenic mice three human components involved in T-cell recognition of an MS-relevant autoantigen presented by the HLA-DR2 molecule: DRA*0101/DRB1*1501 (HLA-DR2), an MHC class II candidate MS susceptibility genes found in individuals of European descent; a T-cell receptor (TCR) from an MS-patient-derived T-cell clone specific for the HLA-DR2 bound immunodominant myelin basic protein (MBP) 4102 peptide; and the human CD4 co-receptor (Madsen L S. Nat Genet. 1999 23:258-9). The amino acid sequence of the MBP 84-102 peptide is the same in both human and mouse MBP. Following administration of the MBP peptide, together with adjuvant and pertussis toxin, transgenic mice developed focal CNS inflammation and demyelination that led to clinical manifestations and disease courses resembling those seen in MS. Spontaneous disease was observed in 4% of mice. When DR2 and TCR double-transgenic mice were backcrossed twice to Rag2 (for recombination-activating gene 2)-deficient mice, the incidence of spontaneous disease increased, demonstrating that T cells specific for the HLA-DR2 bound MBP peptide are sufficient and necessary for development of disease. This study provided evidence that HLA-DR2 can mediate both induced and spontaneous disease resembling MS by presenting an MBP self-peptide to T cells.

Susceptibility to multiple sclerosis is associated with the human histocompatibility leukocyte antigen (HLA)-DR2 (DRB1*1501) haplotype. Wiley and colleagues determined the structure of HLA-DR2 was determined with a bound peptide from human myelin basic protein (MBP) that was immunodominant for human MBP-specific T cells (Smith K J. J Exp Med. 1998 188:1511-20; Gauthier L. Proc Natl Acad Sci USA. 1998 95:11828-33). Residues of MBP peptide that are important for T cell receptor recognition are prominent, solvent exposed residues in the crystal structure. A distinguishing feature of the HLA-DR2 peptide binding site is a large, primarily hydrophobic P4 pocket that accommodates a phenylalanine of the MBP peptide. The necessary space for this aromatic side chain is created by an alanine at the polymorphic DRbeta 71 position. These features make the P4 pocket of HLA-DR2 distinct from DR molecules associated with other autoimmune diseases.

The binding site orientation of Ii-Key/antigenic epitope hybrids can be proposed from analysis of the binding of TCR with hMBP/DR2 complexes. The structural basis for the specificity of ternary complex formation by the TCR and MHC/peptide complexes was examined for myelin basic protein (MBP)-specific T-cell clones restricted by different DR2 subtypes (Wucherpfennig K W. Proc Natl Acad Sci USA. 1995 92:8896-900). Conserved features of this system allowed a model for positioning of the TCR on DR2/peptide complexes to be developed: (i) The DR2 subtypes that presented the immunodominant MBP peptide differed only at a few polymorphic positions of the DR beta chain. (ii) TCR recognition of a polymorphic residue on the helical portion of the DR beta chain (position DR beta 67) was important in determining the MHC restriction. (iii) The TCR variable region (V) alpha 3.1 gene segment was used by all of the T-cell clones. TCR V beta usage was more diverse but correlated with the MHC restriction, i.e., with the polymorphic DR beta chains. (iv) Two clones with conserved TCR alpha chains but different TCR beta chains had a different MHC restriction but similar peptide specificity. The difference in MHC restriction between these T-cell clones appeared due to recognition of a cluster of polymorphic DR beta-chain residues (DR beta 67-71). MBP(85-99)-specific TCRs, therefore, appeared to be positioned on the DR2/peptide complex such that the TCR beta chain contacted the polymorphic DR beta-chain helix while the conserved TCR alpha chain contacted the nonpolymorphic DR alpha chain.

Table 20.1 presents the deduced amino acid sequence of human myelin basic protein (GenBank gi:17378805). Table 20.2 presents MHC Class II-presented epitopes of human myelin basic protein predicted with the SYFPEITHI program. Table 20.3 presents sequences identified experimentally to contain hMBP MHC Class II-presented epitopes (Pette M. Proc Natl Acad Sci USA. 1998 87:7968). Table 20.4 presents hybrids incorporating epitopes of Table 20.2. Table 20.5 presents Ii-Key/antigenic epitope hybrids incorporating epitopes from peptides of Table 20.3. Table 20.6 presents the deduced amino acids sequence of human proteolipid protein 1 (GenBank gi 19923104). Table 20.7 presents MHC Class II-presented epitopes of proteolipid protein 1 predicted with the SYFPEITHI program. Table 20.8 presents sequences identified experimentally to contain proteolipid protein 1 MHC Class II-presented epitopes. Table 20.9 presents hybrids incorporating epitopes of Table 20.7. Table 20.10 presents Ii-Key/antigenic epitope hybrids incorporating epitopes within peptides of Table 20.8. Table 20.11 presents the deduced amino acids sequence of human myelin-oligodendrocyte glycoprotein precursor (GenBank gi: 2497312). Table 20.12 presents MHC Class II-presented epitopes of oligodendrocyte glycoprotein precursor predicted with the SYFPEITHI program. Table 20.13 presents sequences identified experimentally to contain oligodendrocyte glycoprotein precursor MHC Class II-presented epitopes. Table 20.14 presents hybrids incorporating epitopes of Table 20.12. Table 20.15 presents Ii-Key/antigenic epitope hybrids incorporating epitopes within peptides of Table 20.13.

TABLE 20.1

Deduced amino acids sequence of human myelin basic protein. (SEQ ID NO: 824)

```
  1 mgnhagkrel naekastnse tnrgesekkr nlgelsrtts ednevfgead
 51 anqnngtssq dtavtdskrt adpknawqda hpadpgsrph lirlfsrdap
101 gredntfkdr psesdelqti qedsaatses ldvmasqkrp sqrhgskyla
151 tastmdharh gflprhrdtg ildsigrffg gdrgapkrgs gkdshhpart
201 ahygslpqks hgrtqdenpv vhffknivtp rtpppsqgkg rglslsrfsw
251 gaegqrpgfg yggrasdyks ahkgfkgvda qgtlskifkl ggrdsrsgsp
301 marr
```

TABLE 20.2

Predicted MHC Class II-presented epitopes of human myelin basic protein.

| PEPTIDE | Pos. | Sequence | Allele | Ii-Key | SEQ ID NO: |
|---|---|---|---|---|---|
| 20.2.1 | 284 | LSKIFKLGG | 01, 11(281) | 4 | 825 |
| 20.2.2 | 88 | RPHLIRLFS | 01, 03(89), 04(88) | 0 | 826 |
| 20.2.3 | 4 | HAGKRELNA | 01 | 0 | 827 |

TABLE 20.2-continued

Predicted MHC Class II-presented epitopes of human myelin basic protein.

| PEPTIDE | Pos. | Sequence | Allele | Ii-Key | SEQ ID NO: |
|---|---|---|---|---|---|
| 20.2.4 | 272 | HKGFKGVDA | 01, 02(273) | 0 | 828 |
| 20.2.5 | 117 | LQTIQEDSA | 03 | 0 | 829 |
| 20.2.6 | 167 | RDTGILDSI | 03, 11(169) | 3 | 830 |
| 20.2.7 | 66 | DSKRTADPK | 03 | 0 | 831 |
| 20.2.8 | 221 | VHFFKNIVT | 04 | 0 | 832 |
| 20.2.9 | 152 | ASTMDHARH | 04 | 0 | 833 |
| 20.2.10 | 29 | KRNLGELSR | 01, 04, 11 | 0 | 834 |
| 20.2.11 | 176 | GRFFGGDRG | 04, 11(175) | 9 | 835 |

Pos. is the first amino acid of the predicted MHC Class II-presented epitope of the specified sequence. Score is the score calculated by the SYFPEITHI program for the first of the given HLA-DRB*_01 alleles which were examined. The second listed allele is for exactly the same epitope or for an overlapping epitope for which the first amino acid position is given in parentheses.

TABLE 20.3

Experimentally determined MHC Class II-presented epitopes of human myelin basic protein. (SEQ ID NOS: 836-841 respectively, in order of appearance)

| Peptide | Pos. | Presenting MHC II | Sequence | Predicted epitope |
|---|---|---|---|---|
| 20.3.1 | 1-44 | DR2a | MGNHAGKREL NAEKASTNSE TNRGESEKKR NLGELSRTTS EDNE | |
| 20.3.2 | 76-91 | DR2a | AWQDA HPADPGSRPH LIRLFSRDAP GREDNTFKDR P | |
| 20.3.3 | 131-145 | DR2a | LDVMASQKRP SQRHG | 132 |
| 20.3.4 | 139-153 | DR2a; DR1 | P SQRHGSKYLA TASTM | 148 |
| 20.3.5 | 80-99 | DR2b | A HPADPGSRPH LIRLFSRDA | 91, 92 |
| 20.3.6 | 148-162 | DR2b | LA TASTMDHARH GF | 148 |

Pos. is the first and last amino acids of the segments of hMBP reported to contain MHC Class II-presented epitopes. Sequence is a peptide identified by Pette and colleagues to contain hMBP MHC Class II-presented epitopes (Pette M. Proc Natl. Acad Sci USA. 1998 87:7968). The peptides MBP85-99, MBP85-96 and MBP83-97 have also been characterized by others (Krogsgaard M. J Experi Med. 2000 191: 1395-412; Gauthier L. Proc. Natl. Acad Sci USA. 1998 95:11828-33). Presenting allele includes MHC Class II alleles which are reported to present epitopes in the respective segments. Seq. is the sequence of the segment. Predicted epitope is the first amino acid of the epitopes predicted to be presented by respective MHC Class II alleles, using the Pro-Pred algorithm. HMBP(91-98; FIRLFSRDA) (SEQ ID NO: 842) presented by HLA-DRB*0101, 1101, and 1301. hMBP (92-99; IRLFSRDAP) (SEQ ID NO: 843) presented by HLA-DRB*1301 and 1501. hMBP(120-128; IQWDSAATA) (SEQ ID NO: 844) presented by HLA-DRB*03. hMBP(133-141; VMASQKRPS) (SEQ ID NO: 845) presented by HLA-DRB*0101, and 1301. hMPB(148-157; LATASTMDH) (SEQ ID NO: 846) presented by HLA-DRB*0401 and 1101. hMBP(162-170) presented by HLA-DRB*0801.

TABLE 20.4

Ii-Key/human MBP antigenic epitope hybrids with MHC Class II-Presented epitopes of Table 20.2. (SEQ ID NOS: 847-851 respectively, in order of appearance)

| PEPTIDE | Pos. | Sequence |
|---|---|---|
| 20.4.1 | 284 | Ac-LRMK-LSKIFKLGG-NH$_2$ |
| 20.4.2 | 88 | Ac-LRMK-RPHLIRLFS-NH$_2$ |
| 20.4.3 | 4 | Ac-LRMK-HAGKRELNA-NH$_2$ |
| 20.4.4 | 272 | Ac-LRMK-HKGFKGVDA-NH$_2$ |
| 20.4.5 | 117 | Ac-LRMK-HKGFKGVDA-NH$_2$ |

TABLE 20.5

Ii-Key/human MBP antigenic epitope hybrids with MHC Class II-Presented epitopes of Table 20.3. (SEQ ID NOS: 852-855 respectively, in order of appearance)

| PEPTIDE | Pos. | Sequence |
|---|---|---|
| 20.5.1 | 91 | Ac-LRMK-FIRLFSRDA-NH$_2$ |
| 20.5.2 | 92 | Ac-LRMK-IRLFSRDAP-NH$_2$ |
| 20.5.3 | 133 | Ac-LRMK-VMASQKRPS-NH$_2$ |
| 20.5.4 | 148 | Ac-LRMK-LATASTMDH-NH$_2$ |

Another major component of CNS myelin, the proteolipid protein (PLP), induces an acute form of EAE in SJL/J mice (Tuohy V K. J Immunol. 1989 142:1523-7; Greer J M. J Immunol. 1992 149:783-8). A principal MHC Class II-presented epitope was found in 139-154 HCLGKWLGHPDK-FVGI (SEQ ID NO: 856), and in certain serine-substituted homologs. The sequence of the homologous human sequences are presented in Table 20.2. A second peptide murine 178-191 of PLP (Human homolog sequence: FNT 181 WTTCDSIAFP S) (SEQ ID NO: 857) was also identified to be encephalitogenic in SJL/J (h-2s) mice (Greer J M. J Immunol. 192 149:783-8).

TABLE 20.6

Deduced amino acids sequence of human proteolipid protein. (SEQ ID NO: 858)

1 mglleccarc lvgapfaslv atglcffgva lfcgcgheal tg tekliety

TABLE 20.6-continued

Deduced amino acids sequence of human proteolipid protein. (SEQ ID NO: 858)

51 fsknyqdyey linvihafqy viygtasfff lygalllaeg fy ttgavrqi 101 fgdyktticg kglsatvtgg qkgrgsrgqh qahslervch cl gkwlghpd 151 kfvgityalt vvwllvfacs avpvyiyfnt wttcdsiafp sk tsasigsl 201 cadarmygvl pwiafpgkvc gsnllsickt aefqmtfhlf ia afvgaaat 251 lvslltfmia atynfavlkl mgrgtkf

TABLE 20.7

Predicted MHC Class II-presented epitopes of human myelin proteolipid protein.

| PEPTIDE | Pos. | Sequence | Allele | Ii-Key | SEQ ID NO: |
|---|---|---|---|---|---|
| 20.6.1 | 77 | FFFLYGALL | 01, 07(78), 08(78), 15(78) | 8 | 859 |
| 20.6.2 | 243 | FVGAAATLV | 01, 04(244), 11(244) | 4 | 860 |
| 20.6.3 | 236 | FHLFIAAFV | 01, 07(232), 11(232) | 7 | 861 |
| 20.6.4 | 250 | LVSLLTFMI | 01, 03, 04, 13, 15 | 8 | 862 |
| 20.6.5 | 162 | WLLVFACSA | 01, 03(160), 07(156), 08, 11(160) | 7 | 863 |
| 20.6.6 | 99 | IFGDYKTTI | 03 | 0 | 864 |
| 20.6.7 | 199 | LCADARMYG | 03 | 0 | 865 |
| 20.6.8 | 70 | VIYGTASFF | 03, 04(69), 08(69), 11(69), 13(69) | 3 | 866 |
| 20.6.10 | 57 | YEYLINVIH | 04 | 8 | 867 |
| 20.6.11 | 152 | VGITYALTV | 08 | 6 | 868 |

Pos. is the first amino acid of the predicted MHC Class II-presented epitope of the specified sequence. Score is the score calculated by the ProPred program for the first of the given HLA-DRB*_01 alleles which were examined. The second listed allele is for exactly the same epitope or for an overlapping epitope for which the first amino acid position is given in parentheses).

TABLE 20.8

Experimentally determined MHC Class II-presented epitopes of human myelin proteolipid protein.

| PEPTIDE | Pos. | Sequence | Ii-Key | SEQ ID NO: |
|---|---|---|---|---|
| 20.7.1 | M139-151 | 139-154 HCLGKWLGHPDKFVGI | 5 | 869 |

A series of 4 or more overlapping sequences from position 152 (FVGITYALTVVWLLVFAC) (SEQ ID NO: 870) are presented by alleles HLA-DRB 01, 03, 04, 07, 08, 11, 13, 15. The Ii-Key motif LGKWL (SEQ ID NO: 871) is separated by 5 amino acids from F152.

TABLE 20.9

Ii-Key/PLP epitope hybrids containing MHC Class II-presented epitopes of Table 20.7. (SEQ ID NOS: 872-875 respectively, in order of appearance)

| PEPTIDE | Pos. | Sequence |
|---|---|---|
| 20.8.1 | 77 | Ac-LRMK-FFFLYGALL-NH$_2$ |
| 20.8.2 | 243 | Ac-LRMK-FVGAAATLV-NH$_2$ |

TABLE 20.9-continued

Ii-Key/PLP epitope hybrids containing MHC Class II-presented epitopes of Table 20.7. (SEQ ID NOS: 872-875 respectively, in order of appearance)

| PEPTIDE | Pos. | Sequence |
|---|---|---|
| 20.8.3 | 236 | Ac-LRMK-FHLFIAAFV-NH$_2$ |
| 20.8.4 | 250 | Ac-LRMK-LVSLLTFMI-NH$_2$ |

TABLE 20.10

Ii-Key/PLP epitope hybrids containing MHC Class II-presented epitopes of Table 20.8. (SEQ ID NO: 876)

| PEPTIDE | Pos. | Sequence |
|---|---|---|
| 120.9.1 | 152 | Ac-LRMK-FVGITYALTVVWLLVFAC-NH$_2$ |

A third protein of myelin, human myelin-oligodendrocyte glycoprotein (MOG) has also been shown to be encephalitogenic in mice (Mendel I. Eur J Immunol. 1995 25:1951-9; Kaye J F. J Neuroimmunol. 2000 102:189-98).

TABLE 20.11

Deduced amino acid sequence of myelin-oligodendrocyte glycoprotein precursor. (SEQ ID NO: 877)

1 maslsrpslp sclcsfllll llqvsssyag qfrvigprhp ir
   alvgdeve 51 lperispgkn atgmevgwyr ppfsrvvhly rngkdqdgdq ap
   eyrgrtel 101 lkdaigegkv tlrirnvrfs deggftcffr dhsyqeeaam el
    kvedpfyw 151 vspgvlvlla vlpvlllqit vglvflclqy rlrgklraei en
    lhrtfdph 201 flrvpcwkit lfvivpvlgp lvaliicynw lhrrlagqfl
    eelrnpf

TABLE 20.12

Predicted MHC Class II-presented epitopes of human myelin myelin-oligodendrocyte glycoprotein precursor.

| PEPTIDE | Pos. | Sequence | Allele | Ii-Key | SEQ ID NO: |
|---|---|---|---|---|---|
| 20.11.1 | 155 | LVLLAVLPV | 01, 03, 04 | 5 | 878 |
| 20.11.2 | 200 | FLRVPCWKI | 01, 07 | 3 | 879 |
| 20.11.3 | 31 | FRVIGPRHP | 01 | 0 | 880 |
| 20.11.4 | 217 | LGPLVALII | 01 | 5 | 881 |
| 20.11.5 | 211 | FVIVPVLGP | 01, 04, 11 | 6 | 882 |
| 20.11.6 | 15 | FLLLLLLQV | 01, 03(18), 04(18), 15(12) | 0 | 883 |
| 20.11.7 | 43 | LVGDEVELP | 03 | 5 | 884 |
| 20.11.8 | 99 | LLKDAIGEG | 03 | 0 | 885 |
| 20.11.9 | 111 | LRIRNVRFS | 03, 08 | 6 | 886 |

TABLE 20.12-continued

Predicted MHC Class II-presented epitopes of human myelin myelin-oligodendrocyte glycoprotein precursor.

| PEPTIDE | Pos. | Sequence | Allele | Ii-Key | SEQ ID NO: |
|---|---|---|---|---|---|
| 20.11.10 | 164 | LLLQITVGL | 04, 07(166) | 0 | 887 |
| 20.11.11 | 149 | WVSPGVLVL | 07 | 5 | 888 |
| 20.11.12 | 179 | YRLRGKLRA | 08 | 0 | 889 |
| 20.11.13 | 229 | WLHRRLAGQ | 08 | 0 | 890 |

Pos. is the first amino acid of the predicted MHC Class II-presented epitope of the specified sequence. Score is the score calculated by the ProPred program for the first of the given HLA-DRB*_01 alleles which were examined. The second listed allele is for exactly the same epitope or for an overlapping epitope for which the first amino acid position is given in parentheses).

TABLE 20.13

Experimentally determined MHC Class II-presented epitopes of myelin-oligodendrocyte glycoprotein precursor.

| PEPTIDE | Pos. | Sequence | SEQ ID NO: |
|---|---|---|---|
| 20.12.1 | h21-39 | LLQVSSSYAG QFRVIGPRH | 891 |

TABLE 20.14

Ii-Key/MOG epitope hybrids containing MHC Class II-presented epitopes of Table 20.12. (SEQ ID NOS: 892-895 respectively, in order of appearance)

| PEPTIDE | Pos. | Sequence |
|---|---|---|
| 20.13.1 | 155 | Ac-LRMK-LVLLAVLPV-$NH_2$ |
| 20.13.2 | 200 | Ac-LRMK-FLRVPCWKI-$NH_2$ |
| 20.13.3 | 31 | Ac-LRMK-FRVIGPRHP-$NH_2$ |
| 20.13.4 | 211 | Ac-LRMK-FVIVPVLGP-$NH_2$ |

TABLE 20.15

Ii-Key/MOG epitope hybrids containing MHC Class II-presented epitopes of Table 20.13. (SEQ ID NOS: 896 & 897)

| PEPTIDE | Pos. | Sequence |
|---|---|---|
| 20.14.1 | 16-27 | Ac-LRMK-FLLLLLLQVSSSY-$NH_2$ |
| 20.14.2 | 13-23 | Ac-LRMK-FRVIGPRHPIRA-$NH_2$ |

Peptide 20.14.1 contains three overlapping MHC Class II-presented epitopes presented by alleles HLA-DRB 01, 03, 04, 07, 11, 13, and 15. Peptide 20.14.2 contains two overlapping MHC Class II-presented epitopes presented by alleles HLA_DRB 01, 08 and 11.

Example 21

Identification and Use of Peptide Sequences Containing Ii-Key Motifs Appropriately Placed from the N-Terminal End of MHC Class II Antigenic Epitopes In another aspect this invention relates to methods to select a preferred set of biologically active MHC Class II-presented epitopes in antigenic proteins. Specifically, this disclosure provides methods to identify in the amino acid sequence of a protein the presence or absence of a Ii-Key immunoregulatory motif of 5 amino acids preceding an experimentally determined or algorithm-predicted, MHC Class II-presented, antigenic epitope. This immunoregulatory Ii-Key motif enhances charging of the linked antigenic epitope into the antigenic peptide binding site of MHC Class II molecules. Given predictions of antigenic epitopes within a protein, identifying the subset of those epitopes preceded by an Ii-Key motif improves greatly the efficiency of vaccine peptide selection. Also, by modifying the sequence of a protein, either to introduce or to eliminate an Ii-Key motif before selected MHC Class II-presented epitopes, the immunological response to that protein can be altered.

This disclosure presents a method to identify an Ii-Key immunoregulatory motif. Specifically, in the sequence of a protein, the immunoregulatory, Ii-Key motif is a segment of 5 contiguous amino acids containing at least two amino acids of the group comprising Leu, Ile, Val, Phe, and Met, and at least one of the group comprising His, Lys, and Arg, where that contiguous 5 amino acid segment is separated by 5 to 11 amino acids from the N-terminal residue of the MHC Class II-presented epitope. The subset of such antigenic epitopes with the presence of an appropriately spaced Ii-Key motif are more potent than epitopes not preceded by such an Ii-Key motif in enhancing the potency of the CD4+ T cell immune response. Such epitopes are also more likely to be dominant or biologically active. Peptides with such epitopes are favored as vaccines to protect against infectious diseases and cancer, and as immunosuppressive vaccines for allergy, autoimmune disease, and graft rejection.

In another aspect, this invention relates to therapeutic proteins with sequences which are modified in a manner to alter immune responses to the therapeutic proteins. Such proteins include therapeutic proteins, such as hormones, cytokines, or other molecules interacting with cell surface receptors, and enzymes. Modifications of an Ii-Key motif can be made to eliminate its function, or such an Ii-Key motif can be introduced before a putative antigenic epitope when such a motif is lacking. Such modifications can suppress a disadvantageous immune response to the therapeutic protein. Such products include the therapeutic protein, and fragments thereof, and genetic constructs leading to their expression.

This invention is based in the discovery that a naturally occurring Ii-Key motif appropriately spaced before a potential antigenic epitope, selects for biological activity in a subset of MHC Class II binding motifs. The binding of radiolabeled, photo-crosslinking, antigenic peptides to MHC Class II molecules is more efficient during the cleavage and release of the Ii protein from MHC Class II alpha and beta chains in the presence of cathepsin B but not cathepsin D (Daibata M. Mol Immunol. 1994 31:255-260). Mutants of putative cleavage sites in the Ii protein confirmed the role of residues in the R78-K86 region in the final cleavage and release of the avidin-labeled Ii fragments that are still immunoprecipitated with MHC Class II alpha and beta chains (Xu M. Mol Immunol. 1994 31:723-731). The biochemical mechanism of this "final cleavage" region was tested with synthetic Ii-L87-K, which contains six residues with cationic side chains, no anionic side chains and four spaced prolines. This Ii-Key peptide promoted binding or release of antigenic peptides in vitro (Adams S. Eur J Immunol. 1995 25:1693-1702). Structure-activity relationships were characterized with 160 homologs, in antigenic peptide presentation to murine T hybridomas (Adams S. Arzneimittel-Forschung. 1997 47:1069-1077), and with purified HLA-DR1 in a peptide binding/release assay (Xu M. Arzneimittel-Forschung. 1999 49:791-9). The Ii-Key segment hIi(77-92) of the Ii protein promotes the binding of synthetic peptides to MHC Class II molecules by acting at an allosteric site adjacent to one end of the antigenic peptide-binding trough. Furthermore, by coupling this Ii-Key segment through a simple polymethylene linker to an antigenic peptide, the potency of presentation of the epitope to a T hybridoma was enhanced 500 times, relative to only the antigenic epitope (Humphreys R E. Vaccine. 2000 18:2693-7). Thus, comparable, naturally occurring, appropriately spaced Ii-Key motifs can be expected to promote the selection of the subset of antigenic epitopes before which they occur at an appropriately spaced interval. Since synthetic hybrids containing linkers of either the natural sequence of Ii-protein extending from the LRMK motif, or 5-amino-pentanoic acid, were comparably active, no specific side chain interactions were required between the linker and the alpha helices of the antigen-binding site. Thus, the specific amino acids forming a spacer region appear not to be relevant. The hypothesis that naturally occurring Ii-Key-spacer motifs regulate selection of potential MHC Class II epitopes in vivo was tested for presence and spacing of a generic Ii-Key motif from both the N-terminus (active hypothesis) or the C-terminus (indifferent hypothesis) of defined MHC Class II-presented epitopes.

Ii-key motifs in antigenic proteins serve to catalyze insertion of closely following, MHC Class II-presented, antigenic epitopes into peptide binding sites of MHC Class II molecules. It is the Ii-Key motif appropriately spaced before a potential MHC Class II binding peptide, which makes that epitope immunogenic. From this discovery, comes a novel method to select a subset of epitopes identified by consensus motifs for their dominant role in antigen presentation. Such epitopes can be exploited in preventative and therapeutic vaccines. Therapeutic proteins can also be modified to either enhance or suppress immunogenicity.

The following method to identify Ii-Key motifs within the amino acid sequence of antigenic proteins was designed prior to examination of the data set, and tested without alteration. An Ii-Key box was defined to be 5 contiguous residue positions containing at least two residues of the group L, I, V, F, and M and at least one residue of the group H, K, and R. This was the simplest model based on two concepts.

The first critical concept in the design of the method of this invention was the discovery of the motif defining the Ii-Key "core segment". In the natural sequence of the human Ii protein, the core motif was defined to be $L^{77}RMK$ (SEQ ID NO: 3) on the basis of previous experimental studies showing retention by this peptide of at least half-maximal activity of the best Ii-Key peptide in a systematic series of hybrids (Adams S. Arzneimittel-Forschung. 1997 47:1069-77; Humphreys R E. Vaccine 2000 18:2693-7). The core motif of four amino acids is contained within a previously defined segment of 7 amino acids (LRMKLPK) (SEQ ID NO: 4) studied through analysis of 84 homologs with 12 amino acid substitutions at each residue position (Adams S. Arzneimittel-Forschung. 1997 47:1069-77; Xu M. Arzneimittel-Forschung. 1999 49:791-9). In those studies, biological activity was discovered not to require precisely alternating hydrophobic/cationic side chains, provided that at least two hydrophobic and one cationic residue were present within a segment of 4 or 5 residues. For this reason, in defining the structure of an Ii-Key motif in the present invention, the presence of two hydrophobic side chains and at least one cationic side chain in any sequence within a stretch of 5 amino acids was considered to be sufficient for the function of Ii-Key in charging antigenic epitopes into MHC Class II molecules.

The second critical concept in the design of the method of this invention was the discovery of the functional equivalence of L, I, V, F, and M in one set, and H, K, and R in another respective set, in governing the structure of locally folded segments of proteins. This equivalency was discovered in a systematic survey of groups of amino acids in certain patterns either throughout proteins (Vazquez S. Proc Natl Acad Sci USA. 1993 90:9100-4) or in geometrically defined positions around alpha helices (Torgerson S. J Biol Chem. 1991 266:5521-24; Vazquez S. J Biol Chem. 1992 267:7406-10; Rennell D. J Biol Chem. 1992 267:17748-52).

The above method of identifying naturally occurring Ii-Key motifs appropriately spaced from the N-terminus of MHC Class II-presented epitopes was validated though the following analysis. All 36 of the antigenic epitopes reported by Rammensee and colleagues (Rammensee H G. Immunogenetics. 1995 41:178-228) in their analysis of motifs predicting MHC Class II-presented peptides were analyzed, excluding homologous epitopes (for example from difference MHC Class II alleles). The sequences for each of these reported proteins upstream and downstream with respect to the antigenic epitope were obtained from GenBank (www.ncbi.nlm.nih.gov/entrez/query.fcgi?db=Protein). Given the definition of an Ii-Key box to contain 5 contiguous residue positions containing at least two residues of the group L, I, V, F, and M and at least one residue of the group H, K, and R, then the distance of such boxes from the N-terminus or C-terminus of known MHC Class II-presented epitopes within antigenic proteins were determined. A significant minimal spacing of such Ii-Key boxes from the N-terminus but not the C-terminus of such epitopes was anticipated because the biological effect was anticipated to be at the N-terminus and not the C-terminus. The predicted lack of biological effect of such boxes at the C-terminus (and thus the spacing form the C-terminus) was a useful null hypothesis for statistical analysis. Segments of 5 contiguous residues extending progressively in an N-terminal direction from a Rammensee-reported antigenic epitope were tested for the occurrence of an Ii-Key box. The box with the least number of intervening residue positions between the Ii-Key box and the Rammensee-reported antigenic epitope was scored in terms of the number of intervening residue positions (Table 1). A similar analysis, in the mirror image manner was scored distally from the C-terminus of the Rammensee-reported antigenic epitope. The least intervening residue positions to the first Ii-Key box were scored from the C-terminus of the antigenic epitope (Table 21.1).

The response of T cells to a MHC Class II-restricted antigenic epitope is enhanced greatly when that epitope is presented to T cells in a synthetic hybrid peptide linking an Ii-Key sequence (such as Acetyl-Leu-Arg-Met-Lys (SEQ ID NO: 3) [Ac-LRMK-]) (SEQ ID NO: 3) thorough a spacer 5-amino-pentanoic acid to the N-terminus of the MHC Class II-presented epitope. In order to test whether homologous, naturally occurring, Ii-Key/spacer/epitope motifs select for antigenic epitopes during processing of antigenic proteins, the frequency of one prototypic pattern was tested in a series of proteins with respect to placement about their experimentally determined MHC Class II epitopes. A non-empirical, N-terminal distribution (p<0.025) was found for a prototypic Ii-Key/spacer pattern (a 5 amino acid segment containing at least two residues of the group Leu, Ile, Val, Phe, and Met [LIVFM] (SEQ ID NO: 790) and at least one of the group Arg, His, and Lys [RHK]), and spacer length of 4 to 8 residues. This placement was significant in comparison to the empirical placement of the motif from the C-terminus (the indifferent hypothesis). This observation helps to explain the biological activity of only some epitopes among sets of predicted "MHC Class II consensus motifs" in antigenic proteins. It also leads to methods to modulate the immune response to certain antigens.

TABLE 21.1

Spacer length (residue positions) between Ii-Key boxes and terminus of the antigenic epitope.

| Spacer length | N-terminus | C-terminus |
|---|---|---|
| 0 | 2 | 9 |
| 1 | 1 | 2 |
| 2 | 1 | 3 |
| 3 | 0 | 0 |
| 4 | 0 | 0 |
| 5 | 2 | 3 |
| 6 | 5 | 1 |
| 7 | 0 | 2 |
| 8 | 1 | 2 |
| 9 | 4 | 1 |
| 10 | 4 | 1 |
| 11 | 2 | 2 |
| 12 | 0 | 1 |
| 13 | 2 | 0 |
| 14 | 2 | 0 |
| No box | 9 | 7 |
| Sum | 29 | 29 |

By inspection, the pattern for occurrence and placement of the Ii-Key box from the N-terminus of the epitope is very different from that on the C-terminal side, and the pattern of the C-terminal side is not different from that expected to be generated by the Monte Carlo model (random assignment of residue types at the frequency of occurrence in the data set). These observations were subjected to quantitative statistical analysis. The probabilities that the observed difference might have occurred as a random event for various groupings of spacer lengths are given in Table 21.2.

TABLE 21.2

Analysis of distributions of Ii-Key motifs of certain spacer lengths.

| Spacer length | N (obs) | C (obs) | Chi square Vs 0-4 | $p \leq$ |
|---|---|---|---|---|
| 0 to 4 | 4 | 14 | | |
| 5 to 8 | 8 | 6 | 4.097 | 0.05 |
| 5 to 11 | 18 | 12 | 6.467 | 0.025 |
| 5 to 14 | 22 | 13 | 7.854 | 0.01 |

Variations on the definition of a positive Ii-Key box and length and character of a spacer may be proposed. The testing of such alternatives may be performed on a new data set, to avoid a type I statistical error. Such an error did not occur in the present study since the scored motif was precisely and completely defined prior to examination of the current data set.

The fact that Ii-Key motif are found appropriately spaced to the N-terminal side of antigenically active MHC Class II-epitopes supports the view that such Ii-Key motifs are active in the selection of peptides to become bound to MHC Class II molecules in post-Golgi antigen charging compartment of antigen presenting cells. Likewise, the fact that Ii-Key/MHC Class II antigenic epitope hybrid peptides are well presented after immunization in Freund's incomplete adjuvant indicates that the Ii-Key motif on such peptides is active in selection of the epitopes of those peptides for charging in the post-Golgi antigenic peptide charging compartment.

Alteration can be introduced in therapeutic proteins to enhance a favorable characteristic. Use of many therapeutic proteins is limited because an immune response, as evidenced by neutralizing antibodies, developed against the protein, as has been observed with insulin, erythropoietin, and beta-interferon. Given a therapeutic protein to which an immunological response in some patients limits therapeutic use, the current invention may be used to prevent the immune response or mute the response in patients who have developed such response. The process includes the following steps. Examine the primary amino acid sequence. Define within the primary amino acid sequence motifs of MHC Class II-restricted epitopes. Choose epitope which are suitable to be altered at a few amino acids, in a manner to create an Ii-Key box-spacer motif N-terminal to the first residue of the antigenic motif. Synthesize the protein by recombinant molecular genetic methods or by peptide synthesis method. Test the synthetic variant for the induction of a suppressing immune response to the protein, for example by reduction of antibodies upon challenge with the parental therapeutic protein.

Ii-Key motifs upstream to selected MHC Class II-presented epitopes in clinically relevant antigens might lead to novel therapeutic vaccines. Perhaps engineering an Ii-Key spacer motif can alter the immunogenicity of an antigenic epitope within a protein. Particularly for the most N-terminal antigenic epitopes, introduction of one or a few altered residues may be tolerated (Rennell D. J Biol Chem. 1992 267: 17748-52). Such manipulations could generate forms of therapeutic proteins amenable to induction of tolerance.

This method of analysis can be extended to additional antigenic or therapeutic proteins of interest to which in vivo immunosuppressive responses are damaging to the host. For example, an examination of antigenic epitopes in HIV reverse transcriptase shows that antigenic epitopes there may have such upstream Ii-Key like segments, perhaps governing biological potency to establish dominance in establishing tolerance. A conserved universal Th epitope in HIV-1 reverse transcriptase is preceded by an Ii-key-spacer motif. An HIV-1 reverse transcriptase epitope, which was highly conserved among various HIV-1 isolates and was presented by at least four HLA-DR molecules, was discovered by Van der Burg and colleagues in a systematic survey of 20 amino acid peptides through the sequence of that enzyme (van der Burg. J Immunol. 1999 162:152-160). This peptide and the upstream 15 amino acids are the following:

1. 271-290

(SEQ ID NO. 898)
NDIQK LVGKL NWASQI YPGIKVRQLCKLLRGTKALT

Possible MHC Class II-presented epitopes are single underlined and the putative Ii-Key motifs is double underlined. This example illustrates how the presence of an Ii-Key motif appropriately spaced before a MHC Class II-presented epitope can enhance the presentation of that epitope. Further, the presence of the Ii-Key motif may be responsible for the development of a highly efficient immunosuppressive response.

Example 22

Enhancement of Antibody, T Helper Cell, and CTL Responses to MHC Class I Epitopes by Immunizations with Ii-Key/MHC Class Ii Epitope Hybrids Substantially greater immune responses were found in mice immunized with epitopes presented in Ii-Key antigenic epitope hybrids, than in antigenic epitope peptides alone. The immune responses were measured by titers of antibodies to individual antigenic epitopes, epitope-specific-CD4+/IFN-ÿ+ cells, and epitope-specific IFN-ÿ release in the ELISPOT assay.

Two different antigenic epitopes, from pigeon cytochrome C and from HIV gp160, were used in these comparative studies. The PGCC(95-104) epitope was presented in an Ii-Key/antigenic epitope hybrid peptide (Ac-LRMK-ava-IAYLKQATAK-NH$_2$; "Ii-Key/PGCC"; SEQ ID NO: 899) or in an antigenic epitope peptide (Ac-IAYLKQATAK-NH$_2$; ("PGCC"); SEQ ID NO: 900). The HIV gp160(843-855) epitope was presented in: 1) an Ii-Key/antigenic epitope hybrid peptide with two ava residues (Ac-LRMK-ava-ava-AYRAIRHIPR-NH$_2$; "Ii-Key/two-ava/gp160(843-855)"; SEQ ID NO: 901); 2) an Ii-Key/antigenic epitope hybrid peptide with one ava residue (Ac-LRMK-ava-AYRAIRHIPR-NH$_2$; "Ii-Key/one-ava/gp160(843-855)"; SEQ ID NO: 902); 3) an Ii-Key/antigenic epitope hybrid peptide with one ava residue (Ac-LRMK-ava-YRAIRHIPR-NH$_2$; alanine-843 is deleted for more precise measurement of space between epitope and Ii-Key; "Ii-Key/one-ava/gp160(844-855)"; SEQ ID NO: 903); 4) an Ii-Key/antigenic epitope peptide with no "ava" (Ac-LRMK-AYRAIRHIPR-NH$_2$; "gp160(843-855)"); SEQ ID NO: 904). "ava" is delta-aminovaleric acid, which is 5-aminopentanoic acid. Its maximal linear extent approximates the length of the backbone atoms of 2.5 amino acids in a peptidyl sequence. Thus, the two-ava linker bridges the Ii-Key motif from the antigenic epitope by about 5 amino acids. Five amino acids is the number of amino acids of an extended antigenic peptide occupying the antigenic peptide binding trough from the residue that lies in the P1 site to the N-terminally exposed end of a peptide that lies in that trough.

An ELISA assay for antibody responses following immunization with the experimental peptides indicated above was performed as follows. Fifty microliters (µl) of a solution of the coating peptide at 2 µg/well in 0.1 M carbonate buffer, pH 9.5 was added to each well of a 96-well Nunc-immunoplate (#442404) for an overnight incubation at 4° C. After aspiration, 250 µl of phosphate-buffer saline solution containing 3% fetal bovine serum (assay diluent) was added to each well for 2 hr at RT. After washing three times with assay diluent, 50 µl of 20-times diluted mouse serum in 1:3 serial dilution in assay diluent was added to each well for 2 hr at RT. After washing three times with assay diluent, 50 µl of 1 ÿg/ml biotinylated goat anti-mouse IgG1 or IgG2a was added to each well and incubated for 1 hr at RT. After washing three times with assay diluent, 50 µl of streptavidin-horse radish peroxidase conjugate (1:1000) was added to each well and incubated for 30 min at RT. After washing three times with assay diluent, 100 µl of tetramethylbenzidine/H$_2$O$_2$ solution (Pharmingen 264KK) was added to each well for 15 min in the dark at room temperature. The reaction was stopped with 100 µl 1N H$_2$SO$_4$ in each well and the absorbance was read immediately at 450 nm.

Significantly greater antibody titers against PGCC epitope were induced by immunizing with Ii-Key/PGCC(95-104) than with PGCC(95-104) peptide alone, either in CFA (Table 22.1) or in IFA (Table 22.2). C3H/HeJ mice (H-2$^k$) were immunized with 10 nmole of peptides (50 µl) emulsified with an equal volume of complete Freund's adjuvant (CFA), subcutaneously at the base of the tail. On day 14 the mice were boosted subcutaneously at the base of the tail with 10 nmole of peptides (50 µl) emulsified with an equal volume of incomplete Freund's adjuvant (IFA). On day 28 the mice were boosted intravenously with 40 nmole peptides dissolved in Hank's balanced salts solution (HBSS). On day 33 the mice were sacrificed and serum samples were assayed for antibody titers against the PGCC(95-104) epitope peptide.

TABLE 22.1

Antibody induction after immunizations with PGCC(95-104) epitope with complete Freund's adjuvant.

| Immunogen | Dilution$^{-1}$ | | | |
| --- | --- | --- | --- | --- |
| | 20 | 60 | 180 | 540 |
| Ii-Key/PGCC | 1.409 | 1.489 | 0.252 | 0.53 |
| PGCC | 0.128 | 0.057 | 0.016 | 0.004 |
| None | 0.105 | 0.72 | 0.049 | 0.036 |

To vaccinate with IFA, C3H/HeJ mice (H-2$^k$) were immunized with 10 nmole of peptides (50 µl) emulsified with equal amount of IFA, subcutaneously at the base of the tail. On day 14 the mice were boosted with 10 nmole of peptides (50 µl) emulsified with an equal volume of IFA, again subcutaneously at the base of the tail. On day 28 the mice were boosted intravenously with 40 nmole peptides dissolved in Hank's balanced salts solution (HBSS). On day 33 the mice were sacrificed and serum samples were assayed for antibody titers against the PGCC(95-104) epitope peptide.

TABLE 22.2

Antibody induction after immunizations with PGCC(95-104) epitope with incomplete Freund's adjuvant.

| Immunogen | Dilution$^{-1}$ | | | | | |
|---|---|---|---|---|---|---|
| | 20 | 60 | 180 | 540 | 1620 | 4860 |
| Ii-Key/PGCC | 3.503 | 2.995 | 0.782 | 0.205 | 0.071 | 0.024 |
| PGCC | 0.102 | 0.186 | 0.019 | 0.005 | −0.003 | 0.003 |
| None | 0.042 | 0.004 | −0.003 | 0.007 | 0.006 | 0.005 |

Significantly greater antibody titers against the HIV gp160 (843-855) epitope resulted from immunization with Ii-Key/HIV gp160(843-855) hybrid than with HIV gp160(843-855) peptide, both being administered in saline solution (Table 3). B10.A (5R) mice (H-$2^{k/b}$) were immunized with 20 nmole of peptides in 50 µl phosphate-buffered saline solution, intramuscularly in right and left rear legs on days 1 and 2, respectively. On day 14 the mice were boosted intramuscularly with 40 nmole of peptides in 200 µl Hank's balanced salts solution intramuscularly in a rear leg. On day 30 the mice were boosted intravenously with 40 nmole peptides dissolved in Hank's balanced salts solution (HBSS). On day 35 the mice were sacrificed and serum samples were assayed for antibody titers against the HIV gp160(843-855) peptide.

TABLE 22.3

Antibody induction after immunizations with HIV gp160(843-855) epitope peptide in saline solution.

| Immunogen | Dilution$^{-1}$ | | | |
|---|---|---|---|---|
| | 20 | 60 | 180 | 540 |
| Ii-Key/one-ava/ gp160(843-855) | 0.600 | 0.157 | 0.073 | 0.024 |
| Ii-Key/two-ava/ gp160(843-855) | 0.131 | 0.039 | 0.027 | 0.003 |
| Gp160(843-855) | 0.052 | 0.023 | 0.000 | −0.005 |
| None | 0.084 | 0.045 | 0.004 | −0.003 |

The above results demonstrate that presentation of the antigenic epitope in an Ii-Key/antigenic epitope hybrid greatly enhances induction of an antibody response regardless whether CFA or IFA is the vehicle for the first immunization. IFA is composed of bayol oil, and CFA is composed of IFA to which has been added heat-killed *mycobacterium tuberculosis*. In the experiments of Tables 1 and 2, IFA was the vehicle for the second immunization, a subcutaneous booster injection, and HBSS was the vehicle for the third immunization, an intravenous booster injection. Because CFA and IFA mediate phagocytosis of the peptides by professional antigen presenting cells, their use leads to charging of the epitope peptide in the post-Golgi, antigen charging compartment. Therefore, Ii-Key/antigenic epitope hybrids have benefit from two mechanisms for charging to MHC Class II molecules: at cell surface MHC Class II molecules, for example on paraformaldehyde-fixed cells (Adams S. Eur J. Immunol 1995 25:1693-1702), and in the post-Golgi antigen charging compartment, after internalization.

The frequency of CD4$^+$/IFN-γ$^+$ Th-1 helper T cells were greatly increased after immunization with Ii-Key/gp160(843-855) hybrid, as compared to immunization with gp160(843-855) peptide (Table 4). To test the mechanism for the much greater immunogenecity of Ii-Key/epitope hybrids epitope peptides, B10(A) 5R mice were immunized with 10 nmole of either gp160(843-855) peptide or Ii-Key/gp160(843-855) in CFA subcutaneously at the right side of the base of the tail. On day 10 the mice were boosted with 40 nmole of hybrid peptide or epitope peptide in saline by intravenous injection. On day 26 mice were sacrificed and splenic cells were obtained. 1×10$^6$ splenic mononuclear cells were stimulated overnight in the presence of 10 units of recombinant IL-2 and indicated peptides (10 ÿg/ml). During the last 3 hours of incubation, 2 µM monensin (Golgi-stop, Pharmingen) was added to the cultures, and cells were then stained for both cellular surface markers and intracellular IFN-γ. The FACS assay to quantify antigen specific Th1 helper cell responses was performed as follows. The cells were incubated with 1 µg fluorescein blocking reagent (FC/block, Pharmingen) per 10$^6$ cells in 100 µl of staining buffer (Dulbecco's phosphate-buffered saline solution without magnesium or calcium). Those cells were stained at 10$^6$ cells/100 µl with either rat-anti-mouse CD3 or CD4 monoclonal antibodies for 30 min at 4° C. After washing, the cells were re-suspended, fixed with 4% formaldehyde, and permeablized with 0.5% saponin for 20 min at 4° C. The cells were suspended in staining buffer with 0.5% saponin, and stained with the appropriate anti-cytokine or isotype control antibody (IFN-γ, XMG1.2, Pharmingen or IFN-γ isotype control, R3-34, Pharmingen). The cells were incubated for 30 min at 4° C. in the dark, washed and fixed for 10 min with 0.3% formaldehyde in 0.5% saponins in staining buffer for flow cytometric analysis. Flow cytometric analysis was performed as follows. First, CD3$^+$ cells were gated using dual color dot plot of side scatter versus CD3 FITC as the T-gate population. The CD3$^+$ cells were then analyzed for CD4 expression to target the CD3$^+$/CD4$^+$ T-helper cell population. Within this specific cell population, dual color dot plots were used to analyze intracellular interferon-γ cytokine stained by phycoerthyrin (PE)-labeled antibody versus CD3$^+$/CD4$^+$ cells stained with fluorescein-labeled antibody.

The increase in CD4$^+$/IFN-γ$^+$ cells is consistent with stimulation and expansion of antigen-specific Th-1 helper T cells. The Th-1 helper T cell subpopulation is characterized by predominant production of IFN-γ while the Th-2 subpopulation of helper T cells is characterized by preferential production of IL-4 and IL-10. Anti-CD3 antibody, which reacts with T cell receptors, measures all T cells, both resting and CD4$^+$ and CD8$^+$ subpopulations. The increase from about 1.0% to about 2.0% in the CD4+/IFNγ$^+$ antigen-specific subpopulation (as compared with naïve mice) is consistent with studies of others on mice immunization with various antigens (Caraher E M. J Immunol. Methods 2000 244:29; O'Hagan D. J Virol 2001 75:9037; Karulin A Y. J Immunol. 2002 168:545-53; Targoni O S. J Immunol. 2001 166:4757-64; Hesse M D. J Immunol. 2001 167:1353-61; Heeger P S. J Immunol. 2000 165:1278-84; Helms T. J Immunol. 2000 164:3723-32; Yip H C. J Immunol. 1999 162:3942-9).

TABLE 22.4

Double color FACS analysis of murine splenic T cells after vaccination with Ii-Key/HIV gp160(843-855) hybrid or epitope peptides.

| Immunogen | Percentage of cells | | |
|---|---|---|---|
| | CD4$^+$ | CD4$^+$/IFN-γ$^+$ | CD3$^+$/IFN-γ$^+$ |
| Naïve | 32.40 | 1.06 | 2.47 |
| gp160(843-855) | 31.03 | 0.94 | 2.05 |
| Ii-Key/gp160 (843-855) | 31.70 | 1.83 | 4.03 |

An ELISPOT assay for IFN-γ cytokine responses was performed in order to titer more exactly splenic T lymphocyte subset responses to immunization with Ii-Key-ava-gp160 (843-855) or gp160(843-855). The assay was performed as follows. A solution of the cytokine-specific capture antibody (100 µl at 6 µg/ml in phosphate-buffered saline solution, pH 7.2) was added to each well of a 96-well Immunospot plate (M200) for an overnight incubation at 4° C. After aspiration, phosphate-buffer saline solution 200 µl containing 10% fetal bovine serum and 1% penicillin-streptomycin-glutamine (mouse medium) was added to each well for 2 hr at RT. After washing four times with 1% Tween-20 in phosphate-buffered saline solution (wash buffer I), 100 µl of single cell suspensions from the spleens of immunized mice at $10^6$ cells/well were re-stimulated with 100 µl of peptide-epitope at 5 µg/well in mouse medium and incubated for 20-40 hr at 37° C., 5% $CO_2$. After washing twice with phosphate-buffered saline solution (wash buffer II) and four times with wash buffer I, 100 µl of 2 ÿg/ml biotinylated anti-mouse IFN-γ in 1× phosphate buffer saline with 10% fetal bovine serum (dilution buffer) was added to each well for 2 hr at RT. After washing five times with wash buffer I, 100 il of streptavidin-horse radish peroxidase conjugate (1:500) in dilution buffer was added to each well for 1 hr at RT. After washing four times with wash buffer I and two times with wash buffer II, 100 µl of the 3-amino-9-ethylcarbazole/$H_2O_2$ substrate (Pharmingen 551951) was added and incubated for 30-60 min in the dark at RT. The reaction was stopped by washing three times with 200 µl of deionized water. ELISPOT data analysis was performed by using the Immunospot 1.7e software (Cellular Limited Technology). Digitized images of quadruplicate wells were analyzed for the presence of spots in which color density exceeds background based on comparison of control cells (naive splenocytes) and experimental cells (splenocytes of immunized mice) cells. Additional counting parameters for spot size and circularity were applied to gate out speckles caused by non-specific antibody binding. Each spot represents a single cell secreting IFN-γ.

IFN-γ/Th-1 responses were elicited to the HIV gp160(843-855) epitope from immunization with Ii-key/HIV gp160 (844-855) hybrid and HIV gp160(843-855) peptide, both being administered in saline solution (Table 5). C3H/HeJ($H-2^k$) mice were immunized with 40 nmole of peptides (50 µl) emulsified with equal volume of incomplete Freund's adjuvant (IFA), subcutaneously at the base of the tail. On day 13 the mice were boosted subcutaneously at the base of the tail with 40 nmole of peptides (50 µl) emulsified with equal amount of incomplete Freund's adjuvant (IFA). On day 31, the mice were boosted intravenously with 40 nmole peptides dissolved in 100 µl Hank's balanced salts solution (HBSS). On day 35, the mice were sacrificed and single cell suspensions from spleens were assayed for IFN-γ responses to HIV gp160(843-855) peptide.

TABLE 22.5

ELISPOT analysis of murine splenic T cells after vaccination with Ii-Key/HIV gp160(843-855) hybrid or epitope peptides.

| Immunogen | Number | Size |
| --- | --- | --- |
| Ii-Key/gp160(844-855) | 59 (+/−5) | 0.028 (+/−0.006) |
| gp160(843-855) | 5 (+/−3.6) | 0.019 (+/−0.01) |
| None | 0 | 0 |

Number is the mean number of spots (and standard deviation) in triplicate wells and Size is the mean spot size in $mm^2$ (and standard deviation). Ii-Key/gp160(844-855) has one ava spacer (Ii-key-ava-gp160(844-855)).

The data of Tables 22.4 and 22.5 supports the view derived from the data of Tables 1-3 that Ii-Key/antigenic epitope hybrids are significantly more potent immunogens than the comparable antigenic peptides. Furthermore, antigenic epitopes in Ii-Key/antigenic epitope hybrids are well presented after subcutaneous immunization in PBS, without an adjuvant. This fact points to effective use of these peptides as vaccines in humans, for whom various other adjuvants, e.g., CFA or even IFA, are either contraindicated or not preferred.

A cDNA sequence for an Ii-Key/antigenic epitope hybrid peptide can be constructed for delivery as a minigene DNA vaccine. Such a construct is either a minigene composed of one or several repeated gene constructs each encoding the Ii-Key/antigenic epitope, or as such one or more inserts into a DNA vaccine coding for expression of a protein from which the antigenic epitope of the minigene construct was derived. Standard molecular biology techniques are used to generate such minigene constructs (Leifert J A. Hum Gene Ther. 2001 12:1881-92; Liu W J. Virology. 2000 273:374-82).

The DNA structure coding for such a minigene contains the codons for 1) a biologically active Ii-Key peptide such as LRMK or a biologically active homolog of the Ii-Key peptide as taught in U.S. Pat. No. 5,919,639, 2) a spacer composed of ala-ala-ala or other biologically accepted functional equivalent of ava or ala-ala-ala, and 3) the antigenic epitope.

This disclosure reveals that a spacer composed of one delta-aminovaleric acid, which is 5-aminopentanoic acid, is preferred to a spacer composed of two such residues or no spacer at all. Since the linear extent of one delta-aminovaleric acid residue in an Ii-Key/antigenic epitope peptide approximates the linear extent along the backbone of about 2.5 amino acids, the length of the spacer-equivalent in the DNA construct of the minigene is preferably 2, 3 or 4 amino acids, but the length of that spacer can extend from one to 11 amino acids. The codons in the spacer-equivalent segment of the minigene can encode functionally accepted amino acids, but preferable are drawn from the group including small side chain amino acids such as alanine, glycine and serine.

As with other examples presented in this disclosure, the amino acids of the antigenic epitope segment of the Ii-Key/antigenic epitope hybrid may be composed of amino acid sequences coding for one MHC Class II-presented antigenic epitope only, or for such an epitope with attached or overlapping sequence(s) coding for one or more of the following a) a second MHC Class II-presented epitope, b) a MHC Class I-presented epitope, and c) an antibody-recognized epitope.

Immunization with Ii-Key/Class II epitope hybrids enhances CTL responses to MHC Class I epitopes activity by augmenting antigen-specific T helper cell responses. Improved potency of MHC Class II epitope presentation potentiates responses to activity of MHC class I epitopes. Mice were immunized with mixtures of Ii-Key/MHC Class II hybrid with CTL epitope, or MHC Class II epitope+CTL epitope, or CTL epitope alone. The ELISPOT assay showed that immunizing mice with Ii-Key/MHC Class II hybrid with CTL epitope produced enhanced CTL activity (Table 22.6). C3D2F1/J mice were immunized subcutaneously at the base of the tail with a mixture of either: 1) 40 nmole of Ii-key/HIV helper T epitope GP120(91-100)] & 20 nmole of HIV CTL epitope (p18) in IFA, 2) 40 nmole of HIV helper T epitope GP120(91-100) and 20 nmole HIV CTL epitope (p18) in IFA, 3) 20 nmole of HIV CTL epitope (p18) in IFA, or 4) No immunogen. On day 14, the mice were boosted with the same immunogens, as described above, at the base of the tail. On day 32, the mice were boosted one more time subcutaneously. Single cell suspensions from individual mouse spleens were challenged ex vivo five days following the last boost in cultures ($10^6$ cells/well) containing CTL epitope p18 (5 ig/well), a non-specific epitope (5 ig/well) and medium alone. Table 22.6 represents the mean spot values and SD calculated from data averaged from three mice per group in six to nine wells.

TABLE 22.6

ELISPOT analysis of CTL spots after immunization of mice with mixture of Ii-Key/gp120 (91-100) with CTL epitope p18 or mixture of gp120 (91-100) with p18, or p18 alone.

| Immunogen | CTL reaction | Non-specific peptide reaction | Medium |
|---|---|---|---|
| Ii-Key/gp120 (91-100) + p18 | 27 | 6 | 0 |
| Gp120 + p18 | 11 | 5 | 0 |
| P18 | 7 | 0 | 0 |
| Naïve | 5 | 2 | 0 |

Thus, mice immunized with Ii-Key/MHC Class II helper epitopes+CTL epitope exhibited a much greater antigen specific CTL response than mice immunized with CTL epitope alone or MHC Class II epitope+CTL epitope. Covalent coupling of Ii-Key/MHC Class II hybrids and CTL epitopes, or MHC Class II sequences within which CTL epitopes are resident, will also provide enhanced CTL responses. In addition, minigenes and DNA vaccines composed of Ii-Key/MHC Class II hybrids CTL sequences will also induce enhanced CTL reactions.

Example 23

Ii-Key/Melanoma gp100 MHC Class II Antigenic Epitope Hybrids

Melanoma is a leading target in the development of therapeutic peptide and DNA vaccines because several specific tumor-associated antigens have been identified, efficiency of vaccinating mice with peptide or DNA vaccines in treating melanoma is proved, and use of comparable vaccines in the clinic has had occasionally promising results. The use of Ii-Key/melanoma antigenic epitope hybrids in melanoma vaccination is considered in herein for gp100 and tyrosinase, but can be adapted to other melanoma antigens, and furthermore to other tumor antigens related to the immune response to other tumors.

Storkus and colleagues identified peptides containing several MHC Class II-presented epitopes of gp 100/pmel17 and tyrosinase melanocyte-associated antigens and tested the response of tumor-reactive human CD4+ T cells from various melanoma patients against these peptides (Kierstead L S. Br J Cancer. 2001 85:1738-45). Two known and three novel CD4+ T cell epitopes were found using an IFN-gamma ELISPOT assay. Often freshly-isolated PBMC from HLA-DR4+ melanoma patients that are currently disease-free reveal elevated Th1-type CD4+ T-cells that recognize these peptides. Ii-Key/antigenic epitope hybrids incorporating these epitopes are presented in this Disclosure.

One problem in tumor immunotherapy is the fact that hosts can be tolerized to self proteins of the tumor. Intracutaneous immunization of C57BL/6 mice with a human Pmel17/gp100 DNA vaccine, but not the murine DNA, induced T cell-mediated B16 melanoma protection in vivo (Wagner S N. J Invest Dermatol. 2000 115:1082-7). This state of unresponsiveness to the autoantigen Pmel17/gp100 was broken by immunization with a plasmid DNA construct encoding the autologous form of the molecule. Mice receiving of Pmel17/gp100 DNA mounted an antigen-specific cytotoxic T lymphocyte response to M3 melanoma. Furthermore M3 tumors growing in immunized mice lost expression of this melanoma-associated antigen whereas M3 melanomas appearing in control-vector-treated animals were still Pmel17/gp100-positive. Ii-Key/antigenic epitope hybrids with appropriate immunization schemes and adjuvants can preferentially induce a Th1 or Th2 pattern of response thereby breaking tolerance. Such breaking to tolerance in humans with melanoma can be achieved either by immunization with the Ii-Key/melanoma MHC class II epitope hybrid peptide alone or followed by a DNA for the murine or human DNA coding for the antigen containing the MHC class II epitope.

Experiments are disclosed herein demonstrating enhancement of T helper cell responses by the use of Ii-Key/Melanoma gp100 MHC class II epitope hybrid peptide constructs. Linking the Ii-Key functional group LRMK through a simple polymethylene linker to the melanoma gp100(48-56) MHC class II epitope enhanced the vaccine response to that epitope in DR4-IE transgenic mice. Toward choosing an optimal Ii-Key vaccine hybrid for clinical trials, a homologous series of MHC class II peptide vaccines was synthesized testing the effects of spacer length and requirements for natural sequence residues N-terminal to the P1 site residue of the HLA-DR4-presented epitope in gp100(46-58), on both potency of the hybrid and Th-1 vs. Th-2 preference ("skewing") of the response of the stimulated CD4+ T lymphocytes and B-cells. The most effective vaccine hybrid in both ELISPOT cytokine assays with either bulk or CD4+ purified T cells, and in secondary in vitro restimulation ("memory" cell) assays was the one with the shortest linking groups between the Ii-Key moiety and the epitope. There was a lesser variation among the hybrids in antibody responses, which varied in IgG1 versus IgG2a isotype according to the adjuvant. CpG in IFA was as potent as CFA, but gave a dominantly Th1 response. These studies support the view that Ii-Key/MHC class II hybrids can be used to elicit Th1 cell responses in therapy of some cancer patients.

This novel mechanism for boosting responses to MHC class II epitope vaccine peptides exploits a regulatory allosteric site on MHC class II molecules, which site governs tightness of binding of MHC class II epitope peptides. The normal process of MHC class II antigen charging and presentation is highly controlled, in order to assure fidelity in presentation of selected peptides. The Ii protein associates with MHC class II molecules at synthesis in the endoplasmic reticulum and prevents their charging with endogenous peptides otherwise destined for binding to MHC class I molecules. Only after the MHC class II molecule complexes are transported into a post-Golgi compartment, the Ii protein is digested away allowing access to charging MHC class II molecules with exogenous peptides. In order to study the process of concerted cleavage and release of the Ii protein and antigenic peptide charging, several synthetic Ii peptides for biological activity were assayed.

A peptide of the Ii protein, the peptide Ii(77-92; LRMKLP-KPPKPVSQMR; SEQ ID NO.: 905), enhanced presentation of antigenic peptides by living or paraformaldehyde-fixed antigen presenting cells to murine T-cell hybridomas (Adams S. Eur J Immunol. 1995 25:1693-702; Adams S. Arzneimit-telforschung. 1997 47:1069-77). Structure-activity relationship studies of 160 homologs revealed a core sequence (Leu-Arg-Met-Lys-Leu-Pro-Lys; LRMKLPK; SEQ ID NO.: 4) with significantly greater activity than the original 16-amino acid peptide. The shortest sequence with half-maximal activity of the most potent peptide LRMKLPK (SEQ ID NO.: 4), contains only four amino acids (LRMK; SEQ ID NO.: 3).

These Ii-Key peptides appear to act at an allosteric site on MHC class II molecules to facilitate charging and presentation of vaccine peptides into the antigenic peptide binding site.

The potency of presentation of an antigenic epitope from pigeon cytochrome C was enhanced in vitro >250 times when the N-terminus of the antigenic peptide was linked covalently through a simple chemical bridge to the C-terminus of the Ii-Key peptide, forming an Ii-key/antigenic epitope hybrid (Humphreys R E. Vaccine. 2000 18:2693-7). In mouse immunizations, the Ii-Key/HIV Gag(46-59) hybrid significantly enhanced the potency of the Gag epitope as ELISPOT-measured T-cell interferon-γ responses (Kallinteris N L. Vaccine. 2003 21:4124-7). Also an Ii-Key/HER-2/neu MHC class II epitope peptide induced much greater IFN-γ release from PBMC of breast cancer patients than the comparable HER-2/neu MHC class II epitope-only peptide. Such Ii-Key/MHC class II antigenic epitope hybrids have potential applications in vitro as diagnostics and for monitoring immunotherapies. As vaccines, they can be applied to control cancer and infectious diseases. The vaccine potential of a clinically relevant melanoma gp100 MHC class II epitope in immunizations HLA-DR4 transgenic mice is disclosed herein.

In order to further enhancing CTL responses to MHC class I epitope vaccine peptides, several MHC class II epitope peptides have been identified. A principal one is gp100(45-58) which is being tested in NCI clinical trial 990159 (Kierstead L S. Br J. Cancer. 2001 85:1738-45; Topalian S L. J Exp Med 1996 183:1965-71; Touloukian C E. J Immunol. 2000 164:3535-42; Kobayashi H. Cancer Res. 2001 61:7577-84). The co-administration of immunodominant, MHC class I- and MHC class II-restricted epitopes derived from the same or different melanoma-related antigens might increase the immunogenecity and therapeutic efficacy of CTL through the activation or conditioning of a common, intermediary APC (Touloukian C E. J Immunol. 2000 164:3535-42).

gp100 is a well defined target for CD4+ melanoma reactive T-cells. More than 75% of melanoma patients recognize a human gp100 (Cromier). CD8+ T-cells isolated from tumor infiltrating lymphocytes of some patients also recognize human gp100. CD4+ T-cells from melanoma patients proliferate in response to several synthetic gp100 peptides (Topalian S L. J Exp Med. 1996 183:1965-71; Touloukian C E. J. Immunol. 2000 164:3535-42; Kobayashi H. Cancer Res. 2001 61:7577-84). The human gp100(46-58) peptide stimulated PBMC from some melanoma patients who were disease-free after therapy, but not PBMCs from healthy donors. Human CD4+ cell lines generated against gp100(46-58) peptides can lyse human melanoma cells in vitro.

Immunizing HLA-DR4-IE transgenic (Tg) mice with recombinant h-gp100 protein followed by screening of candidate epitopes identified with a computer assisted-algorithm for HLA-DRB1*0401, the most frequent DR allele in melanoma patients, lead to identification of h-gp100(46-58) and study of its clinical relevance (Touloukian C E. J Immunol 2000 164:3535-42). A homologous series of Ii-Key/MHC class II hybrids of that peptide is examined, the hybrids varying systematically in structure and length of the spacer connecting the Ii-Key moiety and the MHC class II epitope in order to define the best Ii-Key/melanoma gp100(46-58) homolog for clinical trials.

Animals. IE-DR4 Tg mice express HLA-DRA-IE alpha and HLA-DRB1*0401-IE beta chimeric genes consisting of the α1 and β2 binding domains from the human HLA-DRA and HLA-DRB1*0401-IE molecules, respectively, and the remaining domains from the murine IE$^d$-α2 and IE$^d$-β2 chains, respectively. Female DR4-IE Tg mice from Taconic Laboratories were studied at the University of Massachusetts Animal Facility, under an approved protocol.

Immunizations. DR4-IE Tg mice were immunized subcutaneously at the base of the tail with 40 nmole or 60 nmole of Ii-Key/gp100 MHC class II hybrid or epitope-only peptides, dissolved in saline and emulsified with an equal volume of either IFA or CFA. The synthetic phosphorothioate-modified CpG ODN 1826, 5' TCC A<u>TGACGTTC</u> <u>CTGACGTT</u> 3' (SEQ ID NO.: 906) immunostimulatory nucleotide (CpG motif underlined) was purchased from Oligos Etc. (Wilsonville, Oreg.). DR4-IE Tg mice were vaccinated s.c. with 60 nmole of designated immunogen in an emulsion with IFA and 60 μg CpG. Three weeks following the first immunization, splenic lymphocytes were obtained for assay of either mixed or purified CD4+ T-cells were assayed for cytokine recall response by IFN-γ, IL-4 and IL-2 ELISPOT. IgG1 and Ig2a antibody titer responses were also assayed by ELISA. An alternative immunization schedule included a single boost two weeks following the original vaccination and assessment of immune responses two weeks after the boost.

Peptides. The MHC class II-restricted human gp100(46-58) epitope was originally identified in DR4-IE Tg mice by Toloukian et al. (J Immunol. 2000 164:3535-42). Various Ii-Key/gp100 hybrids containing this epitope were synthesized as illustrated in Table 1. The N-terminus of the gp100 (46-58) epitope was linked to the Ii-Key segment (LRMK) by one ava (5-aminovaleric acid) spacer. Peptides were synthesized using a solid-phase method based on fluorenyl-methoxy-carbonyl (F-moc) chemistry by Commonwealth Biotechnologies, Inc., (Richmond, Va.) to a 99% purity as assessed by HPLC and mass spectrometry. The peptides were dissolved in sterile water (2 nmole/μl) and stored at −20° C. to −80° C.

Purification of CD4+ T-cells. To assess ex vivo gp100(46-58) specific T-helper activity, splenocyte suspensions were prepared from individual mice after lysing the erythrocytes with Pharmlyse (BD Pharmingen). A mixture of 20×10$^6$ cells (4×10$^6$ cells per mouse with five mice per group) were cultured with 25 mg/mL of gp100(46-58) epitope. After 5 days of culture, purified CD4+ T-cells were isolated using MACS CD4 (L3T4) microbeads (Miltenyi Biotec). Briefly, nonadherent cells were collected from the bulk cultures, washed and labeled with L3T4 microbeads (10 μl of beads per 10×10$^6$ cells) in buffer (PBS supplemented with 2 mM EDTA and 0.5% BSA). The cells were well mixed and incubated for 15 min in the dark at 6-12° C. Fluorochrome-conjugated CD4 antibody was added and incubated for an additional 5-10 min. The cells were washed by adding 10-20× labeling volume of buffer and centrifuging for 10 min at 300×g at 4° C. The cell pellet was resuspended in 500 μl of buffer per 10$^8$ cells for magnetic separation. Columns were placed in the magnetic field of the MACS separator and washed with 500 μl of buffer. The cell suspension was applied to the column and the effluent was collected as the negative fraction. The column was rinsed 3 times with 500 μl of buffer and placed on a holder away from the separator. Fresh buffer (1 mL) was added to the column and the CD4+ T-cell fraction was flushed out with a plunger.

ELISPOT assays. Both unseparated and CD4+ lymphocytes were used in ELISPOT assays. Bulk culture lymphocytes (10$^6$ cells/well) obtained from individual spleens of immunized animals in each group were briefly restimulated with 5 μg of gp100(46-58) epitope-peptide in 96-well immunospot 200 plates for 36 h. Purified CD4+ T-cells were also assayed. ELISPOT assays were performed using BD Pharmingen kits for IFN-γ (cat. no: 551849), IL-4 (cat. no: 551017), and IL-2 according to the manufacturer's instructions.

Briefly, plates were coated overnight at 4° C. with the cytokine capture-Abs. The plates were then blocked with 10% FBS in RPMI 1640 for 2 hr at RT and washed four times with PBS containing 0.05% Tween-20 (wash buffer). Freshly isolated single cell splenocyte suspensions or purified CD4+ T-cells were added to the cytokine antibody pre-coated plates as specified earlier. After 36 hr of cell culture for bulk cultures, or overnight incubation for purified CD4+ T-cells, the plates were washed five times with wash buffer and biotinylated cytokine detection antibodies (2 μg/mL) were added for two hr at RT. The plates were then washed four times with wash buffer and avidin-conjugated horseradish peroxidase (Avidin-HRP) was added at 1:100 dilution and followed by one hr incubation at RT. Avidin-HRP was removed by washing four times with wash buffer and two times with 1×PBS. The spots were developed by adding HRP-3-amino-9-ethylcarbozole substrate (Pharmingen) to the plates for 30 min at RT. Finally, the plates were washed twice with sterile water and dried for one to two hr at RT. The following BD Pharmingen capture and detection mAbs for IFN-γ, IL-4 and IL-2 respectively were used: purified anti-mouse IFN-γ (51-2525KC), IL-4 (51-1819KC), IL-2 (51-1816KC), and biotinylated anti-mouse IFN-γ (51-1818KZ), IL-4 (51-1804KC), IL-2 (51-1817KC). Digitalized images of spots were analyzed with a Series 1 Immunospot Analyzer and Immunospot 1.7e software (Cellular Technology Limited, Cleveland, Ohio). Criteria for spot size, circularity and color density were determined by comparing control and experimental wells. Partially overlapping spots were separated and noise signal caused by substrate precipitation and non-specific antibody binding was eliminated. Only areas meeting the specified criteria were counted as spots. Mean and standard deviations were calculated for all assays. Total spot size area was the product of mean area times number of cells, per well.

ELISA. Nunc immunoplates (Fisher Scientific) were coated with the gp100(46-58) peptide (20 μg/mL) in 100 μl of coating buffer overnight at 4° C. and then blocked for two hr with 20% BSA and 1% Thimerosal in PBS (blocking buffer). The plates were then washed three times with PBST (PBS with 0.05% Tween-20). Sera from immunized animals were added at 1:3 serial dilutions and incubated for two hr at RT. After washing five times with PBST, 2 μg/ml of biotinylated IgG1 (Pharmingen, cat. no. 553441), IgG2a (Pharmingen, cat. no. 550332) and IgE (Pharmingen) specific antibodies were added for one hr at RT. The plates were then washed five times with PBST and Avidin-HRP (Southern Biotechnologies) was added at 1:2000 dilution for one hour incubation at RT. Avidin-HRP was removed by washing five times with PBST. TMB substrate was used for the detection in the colorimetric reaction.

Design of Ii-Key/gp100(46-58) MHC class II hybrids. A primary objective in the design of Ii-Key/MHC class II epitopes hybrids was determining the effects of spacer length and requirements for natural sequence residues N-terminal to the P1 site residue of the HLA-DR4-presented epitope in gp100(48-58), on both potency of the hybrid and Th-1 vs. Th-2 preference ("skewing") of the response of the stimulated CD4+ T lymphocytes and B-cells. Two "extra" amino acids, which do not appear to be part of the antigenic epitope (below), were used in peptide in clinical trials of Touloukian and colleagues. Additional issues relevant to the pharmacokinetics and mechanism of a cancer peptide vaccines were also addressed.

The P1 site residue. Analysis of the gp100(46-58) (RQ-LYPEWTEAQRL) peptide with two epitope prediction programs, (syfpeithi.bmi-heidelberg.com/scripts/MHCServer.dll/home.html and www.imtech.res.in/raghava/propred/index.html) indicated the HLA-DR4-presented epitope to be LYPEWTEAQ (first amino acid $L^{48}$ in P1 pocket). Prior work by Touloukian indicated $L^{48}$ to be the P1 site residue (Touloukian C E. J. Immunol. 2000 164:3535-42). A series of hybrids were therefore systematically synthesized, extending by one amino acid among each of the homologs the natural sequence N-terminal to the putative P1 site residue.

Preference for polymethylene chain versus residues of the native sequence N-terminal to the P1 site residue. Prior studies by others of MHC class II epitope peptides have generally found a requirement for 2 non-epitope or "flanking" residues at both the N- and C-terminal of the MHC class II epitope. Such residues have a "stabilizing effect," leading to an improved potency of presentation, versus peptides comprising solely a 9-amino-acid epitope. Such stabilization can be speculated to result from the following effects. a) Ionic repulsion or attractions might occur between the N-terminal peptidyl backbone ammonium or carboxylate groups with ionic side chains of neighboring MHC class II residues. Such an interaction at the C-terminus has been reported. Extension of the N- or C-termini by 2 amino acids at both ends eliminates such effects. b) Interactions of side chains and/or peptidyl backbone imido and carboxyl groups with side chains of neighboring MHC class II residues. Such interactions cannot occur in Ii-Key hybrids, for amino acids replaced by the polymethylene linker, for example where 5-aminopentanoic acid immediately precedes the P1 site residue. In order to evaluate the role of such additional "epitope flanking" natural sequence, amino acids N-terminal to the P1 residue, hybrids with one, two, or 3 amino acids of the native sequence were synthesized.

Protease protection. After in vivo injection, peptides are degraded by proteolytic cleavage by exopeptidases (removing one or two amino acids at a time from N- or C-termini) or by endopeptidases (cleaving potentially anywhere within a peptide, but usually at selected residues fitting a pocket of the enzyme). N-acetylation and C-amidation block exopeptidases, as done here. Endopeptidase action can be inhibited by replacing the peptidyl backbone with: a) uncleaved homologs, e.g., statins (derivatives of 3-aminohexanoic acid), b) non-natural amino acids, e.g., 3-methyl homologs of natural amino acids such as leucine, and c) a polymethylene bridge or other uncleaved spacer. Here, -ava- was used to replace 2.5 amino acids of backbone length. For incorporation during peptide synthesis, the non-natural amino acid 5-aminopentanoic acid is carboxyl-activated and added, as are other natural amino acids.

Enhanced solubility. Replacing spacer amino acids with the polymethylene bridge often enhances solubility when the replaced amino acids have large hydrophobic side chains. Hydrophobicity is not a property of a solvated molecule, but instead reflects the Gibbs free energy cumulatively over the wall of water molecules at their interface with hydrophobic atoms of the solute. Water molecules within the liquid water environment are rapidly forming and dissolving hydrogen bonds with each other, thus stabilizing those molecules in solution at a lower free energy than possessed by water molecules along a hydrophobic surface to which they cannot bond. The larger the surface area requiring a wall of higher energy water molecules, the more water molecules are in the higher Gibbs free energy state. The methylene bridge of 5-aminopentanoic acid presents close to no hydrophobic surface; n-butanol is very soluble in water. Amino acids with a high degree of hydrophobicity include leucine (L), isoleucine (I), valine (V), phenylalanine (F), methionine (M), alanine (A), tryptophan (W), asparagine (N)—the amidated form of aspartic acid (D), and glutamine (Q)—the amidated form of glutamic acid (E). The more a peptide is composed of such amino acids, the less is its solubility. Here hydrophobic side chains of N and Q of peptide B could be omitted in peptide E, which has actually greater vaccine potency.

Limiting autorelease of hybrids with shorter spacers. In the prior studies, greatest potency in vitro was associated with shorter spacers (Humphreys R E. Vaccine 2000 18:2693-7). That fact lead to the hypothesis that the Ii-Key moiety of a hybrid first interacts with the allosteric site lying outside the antigenic peptide binding site (predicted by the overlapping alignments of the Ii-CLIP peptide and the hemagglutinin antigenic peptide in the crystallographic studies of Wiley and colleagues. Upon replacing the endogenously bound antigenic epitope peptide with the epitope tethered to the Ii-Key moiety, the affinity of the epitope in the antigenic epitope binding trough far exceeds the affinity of the Ii-Key moiety or the allosteric site, and the Ii-Key moiety is pulled from its regulatory site, thus precluding "auto-release," i.e., catalysis of release of the antigenic epitope by action of the tethered Ii-Key moiety at the allosteric site.

Structure-activity rules identified in study. The stimulation of splenic mononuclear lymphocytes from HLA-DR4-IE Tg mice immunized with, respectively, with each of the peptides of Table 1.2 with complete Freund's adjuvant (CFA), was determined in an ELISPOT assay for IFN-γ, IL-4 and IL-2. Three weeks after the booster immunization, bulk mononuclear cells (Table 1.3) or purified CD4+ T-cells (Table 1.4) assayed after a secondary stimulation with epitope-only peptide A.

The Ii-Key/gp100(48-58) hybrid E elicited much higher frequencies of IFN-γ and IL-4 responder cells than did either the gp100(46-58) epitope-only peptide A or the rest of the hybrids. Specificity of the gp100(46-58) specific immune response was confirmed by performing in vitro stimulations with a non-specific DR4 restricted HER-2/neu (776-790) epitope (GVGSPYVSRLLGICL; SEQ ID NO.: 906). Less than 10 spots/well were observed (not illustrated)—a background level.

Since IFN-γ or IL-4 cytokines can be produced by either CD4+ T cells or macrophages in the bulk splenic cell cultures, CD4+ T-cells were immunopurified and assayed (Table 1.4). The IFN-γ secreting pattern of the purified CD4+ T-cells was similar to that of the bulk culture splenocytes. These two experiments demonstrate that the unpurified splenic cells. These results indicated that Ii-Key/gp100 hybrid E primes gp100(48-58)-specific CD4+ T cells more potently in vivo than does the epitope-only peptide A.

CpG is as effective an adjuvant as mycobacterium. In part, towards finding a clinically acceptable adjuvant, CpG was tested. An additional benefit of using CpG was the fact that it elicits a strong Th-1-oriented response through its recognition by TLR7 and TLR8 in mice and humans, respectively. Such TLR activation induces IFN-γ and IL-12 which characterize a Th1 pattern of response. Groups of 5 HLA-DR4-IE Tg mice were immunized with each peptide of Table 1.2, respectively, emulsified in IFA with CpG as an adjuvant. IFN-γ ELISPOT results were comparable to those in mice using CFA. The maximal response occurred in mice receiving peptide E. Repeated experiments, cumulatively testing 20-25 mice per peptide, showed hybrid E consistently to be the most potent, hybrids B and C to be comparable to the epitope-only peptide A, and hybrid D to the less active than any of the preceding. This pattern of results also held whether the mice were assayed 3 weeks after a priming injection, or 2 weeks after one booster injection, which was given two weeks after the priming injection. Spot morphology revealed larger spots in assays of cells from mice immunized with hybrids, than in mice immunized with epitope-only peptides.

Peptide A was used as the in vitro stimulant of CD4+ T cells because theoretically additional T cell clones might have been elicited during primary immunizations with Ii-Key-MHC class II hybrids. Such additional clones might have had a bystander effect on stimulation of clones specific to the gp48-56 epitope, for example by raising the mass of cytokines in the milieu. Such an effect in addition to the proposed regulatory effect on the level of peptide charging (which was proved in studies of charging of biotinylated antigenic epitope peptide (Xu, M. Arzneimittelforschung 1999 49:791-9) cannot be ruled out.

IgG isotype correlates with a balanced Th1/Th2 cytokine profile. Three weeks after vaccination, sera were collected at sacrifice of the mice and subsequently assayed for IgG1, IgG2a, and IgE antibody titers. IgG1 is elicited in a Th2 response, while IgG2a is depends on a Th1 response. Peptide A-specific IgG1 titers in mice immunized with CFA and hybrids B-E were 5 to 8 times those of mice immunized with epitope-only peptide A. There was no evidence for an IgG2a response in mice immunized with peptides in only either IFA or CFA. However, mice immunized with CpG and hybrid-E in IFA had 3 times greater IgG2a titers than did mice immunized with epitope-only peptide A in either IFA or CFA (Table 1.4). These data are consistent with the view that CpG is a Th1-orienting adjuvant, which not only enhances Th1 cytokines secretion, but also inhibits Th2 cytokines secretion. CFA is also a Th1-orienting adjuvant, here, which induced both Th1 and Th2 cytokines secretion and enhance IgG1 antibody production. Immunizations with IFA induced weaker humoral responses than did vaccinations with CFA, and did not induce significant cellular response. It is concluded that CpG might be used for immunizations in humans.

The above experiments disclose several important rules for design of Ii-Key/MHC class II hybrid peptides. Cassette-insertion of the gp100(48-56) MHC class II-restricted epitope into an Ii-Key/MHC class II epitope hybrid peptide creates a potent vaccine peptide which elicits more potent CD4+ T cell responses, than does the corresponding epitope-only peptide. Several issues in the optimal design and use of such a vaccine peptide for human use have been resolved thorough in vivo immunizations of mice, which are transgenic for HLA-DRβ*0401. This allele is a principal presenter of this epitope. Studies in transgenic mice might be considered to be an ultimate preclinical evaluation, i.e., before engaging in a clinical trial. This study resolves the choice of an effective vaccine peptide. Conclusions may be drawn from the data of this study, several of which are considered below.

First, it is clear that "shortest is best." That is, as another example of Ocham's razor that simplest is best, inclusion in the spacer between the Ii-Key motif and the MHC class II epitope of additional amino acids from the primary sequence of gp100 N-terminal to the P1 site residue is not needed and in some cases is detrimental. Hybrids B, C and D were less potent than hybrid E with the shortest spacer. Mechanistic interpretations for this effect were considered during the design of the hybrids. The data are consistent with a detrimental effect on solubility of additional residues with hydrophobic side chains, and consistent with the additional residues offering additional targets for endopeptidase action and permitting more facile "auto-rejection."

On the other hand, a promiscuously presented peptide, i.e., a vaccine peptide presented by individuals with multiple HLA-DR alleles, might contain multiple overlapping HLA-DR-presented epitopes with different P1 site residues offset by only 1, 2, or 3 residues within the peptide. In such cases, one might prefer retaining additional amino acids such as the NRQ sequence, if those respective amino acids started other epitopes presented by additional HLA-DR alleles. The loss of potency of presentation of one epitope here gp100(48-56) might be balanced in a clinical setting by presentation of the other epitopes in patients not possessing the HLA-DR4 allele.

A closely related scenario is the possibility that insertion of an epitope into an Ii-Key hybrid allows for stimulation of T cells by presenting HLA-DR alleles, which would normally be low responders for this epitope. Such a question can be addressed in the evaluation of the clinical usefulness of MHC class II vaccine peptides in a clinical setting. That is, it is planned to test reactivity of PBMC in a series of DR-genotyped melanoma patients.

Vaccinations with both CFA or CpG adjuvants illustrated greater IFN-γ cytokine secretion by splenic cells of mice immunized with Ii-Key/gp100(48-56) hybrid E than with gp100(46-58) peptide. However, these adjuvants produced different IL-4 cytokine secretion pattern. Furthermore, IL-4 secretion, starting at relatively high basal level, was further enhanced by the using immunizing peptides with the Ii-Key moiety in CFA. However, IL-4 secretion by Th2 cells was down-regulated when CpG was used as an adjuvant. Thus, our studies suggested that the balance of Th1 and Th2 activation reflects the adjuvant used.

Adjuvants play an important role in immune response enhancement and direction of Th1 or Th2 CD4+ T cell activation when they are co-injected with antigen(s). CFA directs the Th1-type immune response while IFA directs the Th2-type immune response (Yip. J Immunol. 1999 162:3942, Cribs, Intern Immunology 2003 15:505). Th1 cells secrete IFN-γ and Th2 cells secret IL-4 and IL-10. A balanced gp100 (46-58)-specific Th1 and Th2 immune response was obtained under CFA adjuvanticity. That is, the results are consistent with those of others (Shibaki. Exper Dermatology. 2002 11:126). Also, the data indicated induction of a strong Th1 response against the CFA adjuvant itself (PPD protein-unpublished data) and a balanced Th1/Th2 gp100(46-58)-specific immune response which was significantly upregulated by hybrid E. CpG has been reported to be a strong Th1 adjuvant down regulating Th2 responses (Liu. Nature Immunol. 2003 4:687, Kumar. Infec Immunol. 2004 72:947; Beinon. Immunology. 2002 105:204). CpG DNA oligonucleotide binds to Toll-like receptor 9 (TLR9) and activates innate immune response through Th1 gene regulator (T-bet) signal pathway. Vaccinations performed in CpG induced a stronger gp100(46-58) specific Th1 response by hybrid E than epitope alone. However, the gp100(46-58) specific Th2 response was abrogated by CpG. CFA also contains CpG in the bacterial DNA genome and the bacterial cell wall bacterial proteins which may be responsible for the Th2 (IL-4) induction and thus a balance Th1/Th2 has been induced by CFA. Vaccinations performed in IFA generated humoral, but not cellular immune responses. All hybrids generated higher IgG1 response than the epitope alone.

Antibody isotype is considered to be an indicator for Th1 versus Th2 patterns of immune responses (Yip. J Exper Med. 1998 187:1193, Lewkowich. Int Arch Allergy Immunol. 2004 133:145). With balanced gp100(48-56)-induced IFN-γ and IL-4 secretion, we detected predominantly IgG1 anti-gp100 (46-58) antibody, but not IgG2a. Our data are at variance with reports in which indicate that IFN-γ promotes expression of IgG2a isotype while IL-4 promotes switching to the expression of IgG1 isotype (Clifford. Science. 1987 236:944). However, our observations are consistent with those of others (x) who showed that IgG1 dominates in epitope-specific antibody when a balance between Th1 and Th2 cytokines is induced. We found that while isotype of gp100(46-58)-specific antibody was predominantly IgG1, the isotype of PPD-specific antibody was predominantly IgG2a. Toelier et al. observed similar results in which a IgG2a isotype is induced against PPD while an IgG1 isotype is induced against antigen. In our studies, gp100(46-58)-specific IgG2a titer was found only when CpG was the adjuvant (Table 23.10). CpG did not inhibit production of gp100(46-58)-specific IgG1 as indicated by Liu et al. (Cunningham, J Immunol 2002 169:2900). Our studies suggest that the IL-4 production with CFA might inhibit isotype switch to IgG2a while CpG enhances IgG2a production through down-regulating IL-4. Activation of Th cells and antibody isotype switch may represent two mutually exclusive activities taking place in vivo. The isotype switch for antigen-specific antibodies may be influenced by antigen non-specific environment such as adjuvant effect or general level of cytokines in vivo at that time point. Thus, the use antibody isotype as the indicator for Th1 and Th2 immune response should be used cautiously in DR4-IE Tg mice.

Antibody responses did not exhibit as clear cut a dependence on spacer length/composition as did Th1 responses. This difference might derive form the mechanisms of Ii-Key/MHC class II epitope processing by DC versus B cells. B cell activation needs help from antigen-specific Th cells through T-B cell contact and cytokine secretion. For the activation of Th cells, gp100(46-58) epitope or hybrid peptides might bind to DC surface MHC class II molecules. Such direct charging of hybrids to MHC class II molecules is spacer length-dependent both in vitro (Humphreys R E. Vaccine 2000 18:2693-7) and in vivo (this Disclosure). However, in order to produce gp100(46-58)-specific antibodies, epitope or hybrid peptides are bound by surface IgD molecules for internalization and subsequent binding to MHC class II molecules and surface-expression. The Ii-Key moiety might greatly facilitate binding of a hybrid to MHC class II molecules inside of the B cell under acidic conditions.

Since CFA is not suited for human use due to the induction of severe granulomatous reaction, this report provides evidence that humans can be vaccinated with peptides along with CpG motif. Supplementing IFA with oligonucleotides containing the CpG motif characteristics of bacterial DNA shows similar Th1 polarizing effects as CFA.

Furthermore, MHC class II gp100(46-58) epitope based vaccines can be used in conjunction with MHC class I epitopes such as gp100(209-217(210M)) to induce immune responses capable of eradicating minimal residual disease and extending progression-free survival in patients with Stage III and Stage IV melanoma.

The amino acid sequence of melanocyte protein Pmel 17 was obtained at NCBI, >gi|1125063|gb|AAB00386.1| melanocyte protein Pmel 17 [*Homo sapiens*] =>gi|639590|gb|AAC60634.1| gp100 [*Homo sapiens*].

TABLE 23.1

| Deduced amino acid sequence (SEQ ID NO.: 385) of gp 100/pmel. |
|---|
| 1 mdlvlkrcll hlavigalla vgatkvprnq dwlgvsrqlr tk awnrqlyp |
| 51 ewteaqrldc wrggqvslkv sndgptliga nasfsialnf pg sqkvlpdg |
| 101 viwvnntii ngsqvwggqp vypqetddac ifpdggpcps gs wsqkrsfv |
| 151 yvwktwgqyw qvlggpvsgl sigtgramlg thtmevtvyh rr gsrsyypl |

TABLE 23.1-continued

Deduced amino acid sequence (SEQ ID NO.: 385) of gp 100/pmel.

201 ahsssaftit dqvpfsysys qlraldggnk hflrnqpltf al qlhdpsgy 251 laeadlsytw dfgdssgtli sralvvthty lepgpvtaqv vl qaaiplts 301 cgsspvpgtt dghrptaeap nttagqvptt evvgttpgqa pt aepsgtts 351 vqvpttevis tapvqmptae stgmtpekvp vsevmgttla em stpeatgm 401 tpaevsivvl sgttaaqvtt tewvettare lpipepegpd as simstesi 451 tgslgplldg tatlrlvkrq vpldcvlyry gsfsvtldiv qg iesaeilq 501 avpsgegdaf eltvscqggl pkeacmeiss pgcqppaqrl cq pvlpspac 551 qlvlhqilkg gsgtyclnvs ladtnslavv stqlimpgqe ag lgqvpliv 601 gillvlmavv lasliyrrrl mkqdfsvpql phssshwlrl pr ifcscpig 651 enspllsgqq v

TABLE 23.2

Ii-key/human gp100(48-56) melanoma epitope hybrids

| Peptide | Peptide | N-term | Epitope | C-term | SEQ ID NO |
|---|---|---|---|---|---|
| 23.2.01 | A; AE-40 | Ac— | RQLYPEWTEAQRL | —NH$_2$ | 909 |
| 23.2.02 | B; AE-44 | Ac-LRMK-ava- | NRQLYPEWTEAQRL | —NH$_2$ | 910 |
| 23.2.03 | C; AE-42 | Ac-LRMK-ava- | RQLYPEWTEAQRL | —NH$_2$ | 911 |
| 23.2.04 | D; AE-41 | Ac-LRMK-ava- | QLYPEWTEAQRL | —NH$_2$ | 912 |
| 23.2.05 | E; AE-08 | Ac-LRMK-ava- | LYPEWTEAQRL | —NH$_2$ | 913 |
| 23.2.06 | AE-45 | Ac-LRMK-ava- | ATALYWTEAQRLRL | —NH$_2$ | 914 |
| 23.2.07 | AE-46 | Ac-LRMK-ava- | TALYPEWTEAQRL | —NH$_2$ | 915 |
| 23.2.08 | AE-47 | Ac-LRMK-ava- | ALYPEWTEAQRL | —NH$_2$ | 916 |
| 23.2.09 | AE-48 | Ac-LRMK-ava-ava | LYPEWTEAQRL | —NH$_2$ | 917 |
| 23.2.10 | AE-49 | Ac-LRMK-ava- | NRQLYPEWTEAQR | —NH$_2$ | 918 |
| 23.2.11 | AE-50 | Ac-LRMK-ava- | NRQLYPEWTEAQ | —NH$_2$ | 919 |
| 23.2.12 | AE-51 | Ac— | LYPEWTEAQ | —NH$_2$ | 398 |
| 23.2.13 | AE-52 | Ac— | LYPEWTEAQRL | —NH$_2$ | 920 |
| 23.2.14 | AE-53 | Ac— | RQLYPEWTEAQRL | —NH$_2$ | 907 |
| 23.2.15 | AE-54 | Ac— | LYPEWTEAQRL | —NH$_2$ | 920 |
| 23.2.16 | AE-55 | Ac— | LYPEWTEAQ | —NH$_2$ | 398 |

The N-termini of various gp100(46-58) homologs were linked to the Ii-Key moiety: LRMK by one -ava- (δ-aminovaleric acid; 5-aminopentanoic acid) spacer. The flexible polymethylene spacer was a non-natural amino acid incorporated during peptide synthesis. All peptides were terminally N-acetylated and C-amidated to inhibit exopeptidases. Peptide A is the natural sequence of the melanoma gp100(46-58) peptide deduced to contain a DR-4-restricted epitope $L^{48}$-$Q^{56}$. Peptides B through E are Ii-Key-ava- hybrid peptides with varying N-terminal lengths of the peptides including the deduced epitope.

TABLE 23.3

IFN-γ memory response with total splenic cells from DR4-IE Tg mice immunized with various Ii-Key/gp100 hybrids versus epitope-only peptide in CFA.

| Restimulation | Immunogen - Peptide Code | | | | | |
|---|---|---|---|---|---|---|
| | A | B | C | D | E | Naïve |
| Peptide A | 160 ± 1 | 89 ± 10 | 86 ± 10 | 52 ± 12 | >500 | 9 ± 4 |
| Medium | 7 ± 4 | 8 ± 2 | 3 ± 1 | 4 ± 3 | 9 ± 6 | 9 ± 6 |
| Non-specific | 5 ± 3 | 6 ± 2 | 9 ± 5 | 5 ± 2 | 28 ± 17 | 8 ± 4 |

TABLE 23.4

IL-4 memory response with total splenic cells from DR4-IE Tg mice immunized with various Ii-Key/gp100 hybrids versus epitope-only peptide in CFA.

| Restimulation | Immunogen - Peptide Code | | | | | |
|---|---|---|---|---|---|---|
| | A | B | C | D | E | Naïve |
| Peptide A | 183 ± 2 | 69 ± 10 | 96 ± 10 | 89 ± 27 | 327 ± 2 | 6 ± 2 |
| Medium | 6 ± 3 | 5 ± 3 | 5 ± 1 | 16 ± 10 | 10 ± 56 | 3 ± 1 |
| Non-specific | 11 ± 3 | 15 ± 6 | 11 ± 4 | 11 ± 4 | 16 ± 6 | 6 ± 4 |

Subcutaneous injection of mice with each immunogen (60 nmole in CFA) at the base of the tail. Three weeks following the immunization, single splenocyte suspensions ($10^6$ cells/well) were briefly restimulated in vitro with peptide A (5 μg/well) and assayed for IFN-γ and IL-4 cytokine recall response. Data represent the mean number of spots and standard deviation of memory responder cells in six plicate wells. Stimulation with a non-specific HLA-DR4-restricted HER-2/neu (776-790 GVGSPYVSRLLGICL; SEQ ID NO.: 908) epitope generated a non-significant immune response.

TABLE 23.5

IFN-γ cytokine memory response with purified splenic CD4+ Th cells from mice immunized with Ii-Key/gp100 (46-58) hybrids and epitope-only in CFA.

| Peptide | IFN-γ spots |
|---|---|
| A | 491 |
| B | 165 |
| C | 110 |
| D | 25 |
| E | 1182 |
| Naïve | |

Peptides A-E (60 nmole in CFA), were each injected s.c. in mice at the base of the tail. Three weeks later splenocytes were pooled from five mice per group and restimulated in vitro with peptide A (5 μg/$10^6$ cells) for five days. Following five days of culture, nonadherent cells were collected from the bulk cultures, washed and labeled with L3T4 (CD4) microbeads. The labeled cells were passed through magnetic columns placed in an appropriate MACS separator field. The subsequently isolated CD4+ T-cell fraction was assayed by IFN-γ ELISPOT after overnight incubation.

TABLE 23.6

In vitro IFN-γ cytokine recall response to the HLA-DR4 restricted melanoma gp100(48-56) epitope following Ii-key/gp100 hybrids or epitope-only vaccinations with the immunostimulatory CpG oligonucleotide emulsified in IFA.

| Restimulation | Immunogen - Peptide Code | | | | |
|---|---|---|---|---|---|
| | A | B | C | E | Naïve |
| Peptide A | 75 ± 21 | 35 ± 22 | 64 ± 40 | 166 ± 130 | 8 ± 2 |
| Medium | 5 ± 5 | 4 ± 3 | 5 ± 3 | 5 ± 4 | 3 ± 1 |

TABLE 23.7

In vitro IL-4 cytokine recall response to the HLA-DR4 restricted melanoma gp100 (48-56) epitope following Ii-Key/gp100 hybrids or epitope-only vaccinations with the immunostimulatory CpG oligonucleotide emulsified in IFA.

| Restimulation | Immunogen - Peptide Code | | | | |
|---|---|---|---|---|---|
| | A | B | C | E | Naïve |
| Peptide A | 17 ± 10 | 13 ± 10 | 9 ± 3 | 17 ± 9 | 8 ± 6 |
| Medium | 4 ± 3 | 6 ± 3 | 6 ± 3 | 2 ± 1 | 7 ± 5 |

Five to eight DR4-IE transgenic mice per group were vaccinated s.c. with 60 nmole of designated immunogen in an emulsion with IFA and 60 μg of CpG. IFN-γ and IL-4 memory cytokine recall response against the free gp100(46-58) epitope was assayed by ELISPOT assays using bulk lymphocyte cultures. Data represent the mean number of spots and standard deviation per triplicate wells for Peptide A-stimulated versus non-stimulated of medium-only. Stimulation with a non-specific HLA-DR4-restricted HER-2/neu (776-790 GVGSPYVSRLLGICL; SEQ ID NO.: 908) epitope generated three to six spots (not illustrated).

TABLE 23.8

IgG1 antibody titer response to the DR4-restricted melanoma gp100 (48-56) epitope observed with vaccinations of various Ii-key/gp100 hybrids or epitope-only in CFA.

| Peptide | Dilutions | | | | | | |
|---|---|---|---|---|---|---|---|
| | 1:20 | 1:60 | 1:180 | 1:540 | 1:1620 | 1:4860 | 1:14580 |
| A | 0.714 | 0.360 | 0.219 | 0.128 | 0.104 | 0.093 | 0.091 |
| B | 3.579 | 3.248 | 2.284 | 1.480 | 0.773 | 0.352 | 0.181 |
| C | 3.627 | 3.266 | 2.306 | 1.202 | 0.528 | 0.235 | 0.130 |
| D | 3.527 | 2.936 | 1.211 | 0.554 | 0.227 | 0.117 | 0.081 |
| E | 0.839 | 0.588 | 0.274 | 0.147 | 0.082 | 0.069 | 0.064 |
| Naïve | 0.111 | 0.065 | 0.062 | 0.060 | 0.060 | 0.055 | 0.056 |

TABLE 23.9

IgG1 antibody titer response to the DR4-restricted melanoma gp100 (48-56) epitope observed with vaccinations of various Ii-Key/gp100 hybrids or epitope-only in CpG.

| Peptide | Dilutions | | | | | | |
|---|---|---|---|---|---|---|---|
| | 1:20 | 1:60 | 1:180 | 1:540 | 1:1620 | 1:4860 | 1:14580 |
| A | 2.674 | 1.562 | 0.704 | 0.277 | 0.139 | 0.084 | 0.063 |
| B | 3.280 | 2.423 | 1.810 | 1.214 | 0.549 | 0.245 | 0.121 |
| C | 3.643 | 2.957 | 2.142 | 1.233 | 0.561 | 0.244 | 0.116 |
| E | 3.650 | 3.027 | 2.129 | 1.417 | 0.890 | 0.414 | 0.195 |
| Naive | 0.063 | 0.058 | 0.056 | 0.058 | 0.051 | 0.056 | 0.061 |

TABLE 23.10

IgG2a antibody titer response to the DR4-restricted melanoma gp100 (48-56) epitope observed with vaccinations of Ii-Key/gp100 hybrids or epitope-only in CpG.

| Peptide | Dilutions | | | |
|---|---|---|---|---|
| | 1:20 | 1:60 | 1:180 | 1:540 |
| A | 0.8946 | 0.746 | 0.4938 | 0.323 |
| B | 0.883 | 0.29 | 0.117 | 0.071 |
| C | 1.892 | 0.92 | 0.218 | 0.088 |
| E | 1.363 | 1.196 | 0.733 | 0.323 |
| Naive | 0.063 | 0.058 | 0.056 | 0.055 |

Subcutaneous injection of immunogen (60 nmole) in CFA and CpG at the base of the tail. Three weeks following the original immunization, blood sera were collected and assayed for IgG1, IgG2a and IgE antibody titer responses against the free gp100(46-58) epitope. Vaccinations performed in CFA demonstrated stronger IgG1 response for hybrids B, C and D than the epitope-only peptide, but not IgG2a titer. Vaccinations administered along with the CpG motif elicited a stronger IgG1 response for all hybrids and IgG2a response only for hybrids C and E when compared to the gp100(46-58) epitope-only peptide. There was no evidence for an IgE response regardless the type of adjuvant used.

Example 24

Ii-Key/Melanoma Tyrosinase Antigenic Epitope Hybrids

Tyrosinase has many advantages as a target antigen for the immunotherapy of patients with melanoma because it is expressed in nearly all melanoma specimens with a high degree of cellular homogeneity, and its distribution in normal tissues is limited to melanocytes. Several MHC Class I-presented epitopes have been identified and used clinically, and MHC Class II-presented epitopes have been discovered. The following summaries of the current state-of-the-art in identification and use of peptide vaccines, DNA vaccines, and dendritic cell charging with peptide preparations (tumor cell lysates) are presented in part to illustrate the value of the products and methods of this Disclosure to improving these procedures.

Rosenberg and colleagues identified a HLA-A2.1-presented restricted melanoma tyrosinase epitope (tyrosinase8-17; CLLWSFQTSA; SEQ ID NO.: 480) (Riley J P. J Immunother. 2001 24:212-20). In this study, the comparative binding to HLA-A2.1 of a series of algorithm-predicted peptides versus that of a standard peptide with an intermediate binding affinity was determined. Twelve peptides with binding affinities within 80% of that of the standard peptide stimulated PBMC in vitro from three HLA-A2.1+ patients with metastatic melanoma. PBMC from 23 HLA-A2.1+ patients were stimulated in vitro with tyrosinase(8-17). Eleven bulk T-cell cultures demonstrated specific peptide recognition, and six of these also recognized HLA-A2.1+tyrosinase+melanoma cells. This epitope can be incorporated in an Ii-Key/MHC Class II-presented epitope/MHC Class I-presented epitope hybrid.

Weber and colleagues found that patients with resected melanoma mounted an immune response against gp100(209-217)(210M) (IMDQVPSFV; SEQ ID NO.: 481) and tyrosinase(368-376)(370D) (YMDGTMSQV; SEQ ID NO.: 482), emulsified with incomplete Freund's adjuvant (Lee P. J Clin Oncol. 2001 19:3836-47). Patients received peptides/IFA with or without IL-12 (30 ng/kg) to evaluate the toxicities and immune responses. Immunizations were administered every 2 weeks for 8 weeks, then every 4 weeks for 12 weeks, and then once 8 weeks later. Thirty-four of 40 patients developed a positive skin test response to the gp100 peptide but none responded to the tyrosinase peptide. Immune responses were measured by release of gamma-interferon in an enzyme-linked immunosorbent assay (ELISA) by effector cells in the presence of peptide-pulsed antigen-presenting cells or by an antigen-specific tetramer flow cytometry assay. Thirty-three of 38 patients demonstrated an immune response by ELISA after vaccination, as did 37 of 42 patients by tetramer assay. Twenty-four of 48 patients relapsed with a median follow-up of 20 months, and 10 patients in this high-risk group have died.

Slingluff and colleagues evaluated peptide vaccine immunogenicity of several peptides restricted to different HLA-A alleles in draining lymph nodes and peripheral blood of melanoma patients because vaccine trials have been limited mostly to those associated with HLA-A2, and immune responses have been detected inconsistently (Yamshchikov G V. Int J Cancer. 2001 92:703-11). They vaccinated stage IV melanoma patients with a mixture of gp100 and tyrosinase peptides restricted by HLA-A1 (DAEKSDICTDEY; SEQ ID NO.: 483), HLA-A2(YLEPGPVTA (SEQ ID NO.: 484) and YMDGTMSQV (SEQ ID NO.: 485)) and HLA-A3 (ALLAVGATK; SEQ ID NO,: 486) in an emulsion with GM-CSF and Montanide ISA-51 adjuvant. CTL responses to vaccinating peptides were found in a lymph node draining a vaccine site (sentinel immunized node, SIN) in 5/5 patients (100%) in PBLs of 2/5 patients (40%). Peptides restricted by HLA-A1 and -A3 and HLA-A2 restricted peptide, YMDGTMSQV (SEQ ID NO.: 485), were immunogenic.

Cytotoxic T lymphocytes against melanoma-associated antigens were induced by a recombinant vaccinia virus vector expressing multiple immunodominant epitopes and costimulatory molecules in vivo (Oertli D. Hum Gene Ther. 2002 13:569-75). Patients received psoralen-UV-treated and replication-incompetent recombinant vaccinia virus encoding the three immunodominant HLA-A*0201-restricted epitopes Melan-A(27-35), gp100(280-288), and tyrosinase(1-9) together with two costimulatory molecules, B7.1 and B7.2, in the context of systemic granulocyte-macrophage colony-stimulating factor (GM-CSF) treatment. Subsequent boosts used corresponding synthetic nona-peptides and GM-CSF. Within 12 days of injection of the recombinant vector, cytotoxic T cell responses specific for engineered epitopes were detected in three of three patients. During the vaccination treatment, antigen-specific CTL frequencies exceeding 1:10,000 peripheral CD8+ T cells could be observed.

Two stage IV melanoma patients vaccinated with an HLA-A2- or HLA-A24-restricted tyrosinase peptide, and GM-CSF had long-term freedom from recurrence (Scheibenbogen C. Int J Cancer. 2002 99:403-8). While the patients had experienced 9 and 12 relapses (mostly subcutaneous), respectively, during the 3 years before vaccination, they experienced freedom from relapse for more than 2 years after vaccination. T-cell responses to the vaccine peptide were found in the peripheral blood of both patients using an IFN-gamma ELISPOT assay.

Mule and colleagues found that addition of keyhole limpet hemocyanin (KLH) augmented the efficacy of both tumor lysate-pulsed dendritic cells and peptide-pulsed dendritic cells immunizations for immune priming and rejection of established metastases of the D5 subline of B16 melanoma in vivo (Shimizu K. Cancer Res. 2001 61:2618-24). Interleukin 2 further augmented the enhancement afforded by KLH, as measured by cure rates and overall survival, in the absence of autoimmune depigmentation. KLH added to dendritic cells immunizations markedly enhances tumor-specific T cell production of IFN-gamma. D5 melanoma exposed to similar levels of IFN-gamma results in substantial expression of MHC Class I molecules. Immunization with dendritic cells pulsed with KLH and mouse tyrosinase-related protein-2 peptide results in enhanced reduction of B16 melanoma metastases; the effect is most pronounced in a setting where tyrosinase-related protein-2 peptide-pulsed dendritic cells alone are completely ineffective.

Therapeutic efficacy of a tumor cell-based vaccine against B16 melanoma requires disruption of either of two immunoregulatory mechanisms that control autoreactive T cell responses: the cytotoxic T lymphocyte-associated antigen (CTLA)-4 pathway or the CD25+ regulatory T cells. Combination of CTLA-4 blockade and depletion of CD25+ T cells results in maximal tumor rejection (Sutmuller R P. J Exp Med. 2001 194:823-32). Efficacy of the antitumor therapy correlates with the extent of autoimmune skin depigmentation as well as with the frequency of tyrosinase-related protein 2(180-188)-specific CTLs detected in the periphery. Furthermore, tumor rejection is dependent on the CD8+ T cell subset. The CTL response against melanoma antigens is an important component of the therapeutic antitumor response, and the reactivity of these CTLs can be augmented through interference with immunoregulatory mechanisms. The synergism in the effects of CTLA-4 blockade and depletion of CD25+ T cells indicates that CD25+ T cells and CTLA-4 signaling represent two alternative pathways for suppression of autoreactive T cell immunity. Simultaneous intervention with both regulatory mechanisms is, therefore, a promising concept for the induction of therapeutic antitumor immunity.

Melanoma antigen-specific vaccinations promote significant clinical remission in some melanoma patients (Wolchok J D. Lancet Oncol. 2001 2:205-11). Peptide vaccines with MHC class I epitopes have been tested with moderate clinical benefit. Enhancing the MHC class I-directed CTL response, requires stimulation of MHC class II-directed T-helper cell responses. Adoptive immunotherapy is one of the most promising approaches to treating melanoma patients. CD4+ T-cells have a critical role in cancer immunity by inducing and maintaining CD8+ T-cell and B-cell responses. Increased levels of CD4+/CD25+ regulatory T-cells in certain cancer patients, and the promising clinical results obtained in patients with advanced refractory melanoma receiving adoptive transfer of highly reactive T-cells (CD8+ and CD4+) following non-myeloablative, conditioning chemotherapy, further highlight the utility of a robust CD4+ T-helper cell response in cancer immunity.

The amino acid sequence of tyrosinase as given in GenBank 4507753|ref|NP_000363.1| tyrosinase (oculocutaneous albinism IA); Tyrosinase [*Homo sapiens*] is listed in Table 24.1.

TABLE 24.1

Deduced amino acid sequence (SEQ ID NO.: 487) of tyrosinase.

```
  1 mllavlycll wsfqtsaghf pracvssknl mekeccppws gdrspcgqls
 51 grgscqnill snaplgpqfp ftgvddresw psvfynrtcq csgnfmgfnc
101 gnckfgfwgp ncterrllvr rnifdlsape kdkffayltl akhtissdyv
151 ipigtygqmk ngstpmfndi niydlfvwmh yyvsmdallg gseiwrdidf
201 aheapaflpw hrlfllrweq eiqkltgden ftipywdwrd aekcdictde
251 ymggqhptnp nllspasffs swqivcsrle eynshqslcn gtpegplrrn
301 pgnhdksrtp rlpssadvef clsltqyesg smdkaanfsf rntlegfasp
351 ltgiadasqs smhnalhiym ngtmsqvqgs andpifllhh afvdsifeqw
401 lrrhrplqev ypeanapigh nresymvpfi plyrngdffi sskdlgydys
451 ylqdsdpdsf qdyiksyleq asriwswllg aamvgavlta llaglvsllc
501 rhkrkqlpee kqpllmeked yhslyqshl
```

TABLE 24.2

Designed Ii-Key/tyr(363-382) hybrids.

| Peptide | Peptide N-term | Epitope | C-term | SEQ ID NO |
|---|---|---|---|---|
| 24.2.1 | AE-TYR-1 Ac | ALHIYMDGTMSQVQGSA | —NH$_2$ | 921 |
| 24.2.2 | AE-TYR-2 Ac- | HNALHIYMDGTMSQVQGSA | —NH$_2$ | 922 |

TABLE 24.2-continued

Designed Ii-Key/tyr(363-382) hybrids.

| Peptide | Peptide N-term | Epitope | C-term | SEQ ID NO |
|---|---|---|---|---|
| 24.2.3 | AE-TYR-3 Ac-LRMK-ava- | NALHIYMDGTMSQVQGSA | $-NH_2$ | 923 |
| 24.2.4 | AE-TYR-4 Ac-LRMK-ava- | ALHIYMDGTMSQVQGSA | $-NH_2$ | 924 |
| 24.2.5 | AE-TYR-5 Ac-LRMK-ava- | LHIYMDGTMSQVQGSA | $-NH_2$ | 925 |
| 24.2.6 | AE-TYR-6 Ac-LRMK-ava- | HIYMDGTMSQVQGSA | $-NH_2$ | 926 |
| 24.2.7 | AE-TYR-7 Ac-LRMK-ava- | IYMDGTMSQVQGSA | $-NH_2$ | 927 |
| 24.2.8 | AE-TYR-8 Ac-LRMK-ava- | YMDGTMSQVQGSA | $-NH_2$ | 928 |
| 24.2.9 | AE-TYR-9 Ac-LRMK-ava- | MDGTMSQVQGSA | $-NH_2$ | 929 |

The above peptides test for the P1 site residue by nested deletions from the N-terminal epitope residue; activity is lost when the P1 site residue is deleted. The reported deamidation of asparagine (N) to aspartic acid (D) is tested by comparing responses before and after deamidation. The value of N-terminal acetylation and C-terminal amidation on potency of Ii-Key (MHC class II) hybrids and epitope-only peptides is also tested.

1. YMD and not gene-determined sequence YMN is used since N is deamidated to D (Wolchok J Clin Oncol 20: 3176-1384). The second N is not listed in the above as being deamidated: YMDGTMSQVN (SEQ ID NO.: 1452) is the clinically used sequence. See also a. Lewis, J J Int J Cancer 87: 391-398, 2000
b. Schaed, S G Clin Cancer Res 8: 867-972, 2002
c. Topalian, S L J Exp Med 183: 1965-1971, 1996.

TABLE 24.3

In vitro IFN-γ immune response with normal donor (DR0402) PBMC stimulated with Ii-Key/tyr(363-382)hybrids or tyr(363-382) epitope-only.

| Peptide | Peptide | IFN-γ spots unpulsed | IFN-γ spots pulsed |
|---|---|---|---|
| 24.3.1 | AE-TYR-1 | 0 | 120 |
| 24.3.2 | AE-TYR-2 | 140 | 360 |
| 24.3.3 | AE-TYR-3 | 70 | 310 |
| 24.3.4 | AE-TYR-4 | 340 | 620 |
| 24.3.6 | AE-TYR-6 | 280 | 650 |

Total PBMC were stimulated in vitro for 12 days in the presence of various Ii-Key/tyr(363-382) hybrids or tyr(363-382) epitope-only (50 μg/ml). Ten U/ml IL-2 and 0.2 to 2 ng/ml of IL-12 were added on days 4 and 8 and the cells were further incubated for 4 days. Viable cell yield was assessed on day 12 and IFN-γ ELISPOT assay (3 day format) was used to determine frequencies of peptide specific T-cells. On day 1 of the IFN-γ ELISPOT assay, T cells from replicate wells were plated into 96 well IFN-γ pre-coated plate. On day 2, the cells were restimulated with autologous pulsed or unpulsed irradiated PBMC with Ii-Key/tyr hybrids or epitope only (25 μg/ml). The cells were further incubated for 24 hours and detection of IFN-γ cytokine response was completed.

Example 25

Ii-Key/her-2/Neu MHC Class Ii Antigenic Epitope Hybrids

Ii-Key/Her-2 Neu Antigenic Epitope Hybrids.

Immunotherapy directed against the epidermal growth factor receptor which is overexpressed on some cancer cells can control the growth of those tumors. HER-2/neu is over-expressed on tumors in up to 30% of patients with invasive breast cancer and that over-expression is associated with poor clinical outcome. Carr et al. demonstrated in a retrospective consecutive series from 1995 to 1999 that the HER-2/neu gene was amplified in invasive breast carcinomas of 40 of 90 patients (43%) (Carr J A. Arch Surg. 2000 135:1469-7420). Following initial therapy, patients with HER-2/neu amplification had a shorter median disease-free interval (22 months) than did patients with breast cancers not amplifying that gene (40 months; p=0.003). Disease recurred in seventy-two (72%) patients, with 18 (25%) recurring locally. HER-2/neu gene amplification is an independent prognostic indicator for a subset of breast cancer patients who are at high risk for early recurrence regardless of tumor grade, estrogen/progesterone receptor status, and lymph node status. In both early stage, lymph node-negative and node-positive disease, as well as in women with metastatic disease, HER-2/neu overexpression is associated with worse survival. Women with tumors that overexpress HER-2/neu have a less favorable outcome despite adjuvant treatment with either hormonal therapy or chemotherapy. Among HER-2/neu-negative, early stage patients in the Naples GUN trial, tamoxifen benefited overall survival. However, among patients with HER-2/neu-gene amplification, tamoxifen did not improve survival (De Placido S. Br J Cancer. 1990 62:643-6). HER-2/neu over-expression is an independent predictor for tamoxifen failure. Over-expression of HER-2/neu is selective for tumor cells and is observed early in the course of malignant transformation. More importantly, the cytological characteristics of HER-2/neu over-expression (32%) in primary and metastatic lesions is nearly identical (Masood S. Ann Clin Lab Sci. 2000 30:259-65). Inasmuch as micrometastases are the primary source of relapse following primary therapy and HER-2/neu is over-expressed in metastases, HER-2/neu is an excellent target for immunotherapy of patients with early disease, both to consolidate the anti-tumor response locally and to eradicate micrometastases. Likewise, HER-2/neu should be targeted in conjunction with other major treatment regimens in patients who have relapsed following initial therapy.

Of many approaches to targeting HER-2/neu, the clinically most advanced approach is passive immunotherapy with trastuzumab (Herceptin®), an FDA-approved humanized monoclonal antibody that binds to the extracellular domain of the HER-2/neu receptor for epidermal growth factor (EGF). This monoclonal antibody is indicated both as a single agent and in combination with classical chemotherapies. Slamon et al. evaluated Herceptin® in combination with doxorubicin and cyclophosphamide (AC), or paclitaxel in 496 women with metastatic breast carcinomas that over expressed HER-2/neu (Vogel C L. J Clin Oncol. 2002 20:719-26; Slamon D J. N Engl J Med. 2001 344:783-92). Patients receiving Herceptin®, as compared to patients randomized to chemotherapy alone (either paclitaxel or AC), had a significantly longer time to disease progression (7.4 mo vs. 4.6 mo; $p<0.0001$), a higher rate of objective response (50% vs. 32%; $p<0.001$), a longer duration of response (median 9.1 vs. 6.1; $p<0.001$), a higher 1 year survival rate (78% vs. 67%; $p=0.008$), longer survival (median survival 25.1 mo vs. 20.3 mo; $p=0.046$), and a 20% reduction in the risk of death.

While clinical trials might proceed to alternate trastuzumab dosing regimens and combination therapies, one can suggest that the mechanism of action of trastuzumab will not lead to significantly increased efficacy. Specifically, Trastuzumab blocks the HER-2/neu EGF receptor and induces antibody dependent cellular cytotoxicity (Sliwkowski M X. Semin Oncol. 1999 4 Suppl 12:60-70). ADCC does not lead to antigen-specific memory of T- or B-lymphocytes, nor does it induce proliferation of antigen-specific cytotoxic T-lymphocytes.

HER-2/neu is also the target for several vaccine trials to induce an active specific immune response. In the NCI PDQ, three current clinical trials use HER-2/neu protein, antigen-pulsed dendritic cells, liposome-encapsulated HER-2/neu MHC peptide epitopes, and a DNA vaccine (http://www.cancer.gov/cancer_information/doc.aspx?viewid=F2AFAEA4-64BD-4E44-B421-56026E252389). The rationale, of course, is to enhance therapeutic efficacy and clinical ease of administration by inducing: (1) antigen-specific $CD8^+$ and $CD4^+$ lymphocytes; (2) autoantibodies against HER-2/neu with memory B-cells; and (3) memory helper T cells.

Compared to cell-based vaccines, DNA vaccines, and gene therapy approaches, peptide vaccination is preferred for several reasons. Specifically, peptide vaccines are: (1) easily constructed and manufactured; (2) chemically stable; (3) free of adventitious agents and other pathogens; and, (4) devoid of oncogenic potential. Until recently, most groups have focused on the use of MHC Class I peptide vaccines, which have triggered low-intensity CD8+ cytotoxic T cell responses. Shiku and colleagues have identified a novel human Her-2/neu2-derived peptide which is homologous to a mouse $H-2K^d$-restricted tumor antigen induces HLA-A24-restricted cytotoxic T lymphocytes in ovarian cancer patients and healthy individuals (Okugawa T. Eur J Immunol. 2000 30:3338-46; Ikuta Y. Int J Cancer. 2000 87: 553-8); Nagata Y. J Immunol. 1997 159:1336-43). In addition they have demonstrated presentation of a MHC Class I-binding peptide by monocyte-derived dendritic cells incorporating a hydrophobized polysaccharide-truncated Her-2/neu protein complex (Ikuta Y. Blood. 2002 99:3717-24; Araki H. Br J Haematol. 2001 114:681-9).

Peptide vaccines do enhance responses by CTL cells recognizing MHC Class I-presented peptides, but can be augmented by also immunizing T helper cells with MHC Class II-presented peptides. HER-2/neu-derived, MHC Class II-presented peptides are expressed by human breast, colorectal and pancreatic adenocarcinomas and are recognized by in vitro-induced, specific $CD4^+$ T cell clones (Perez S. Cancer Immunol Immunother. 2002 50:615-24; Sotiriadou R. Br J Cancer. 2001 85:1527-34). Murray et al. showed that the Her-2/neu(777-789) peptide induced peripheral blood mononuclear cells from patients with metastatic breast cancer to secrete IFN-γ (Murray J L. Semin Oncol. 2000 27 Suppl:71-5). This group also showed that Her-2/neu(369-377) induced strong CTL response in peripheral blood mononuclear cells from healthy donors (Anderson B W. Clin Cancer Res. 2000 6:4192-200; Anderson B W. Cancer Immunol Immunother. 2000 49:459-68), as well as the secretion of CXC chemokine IP-10 from peripheral blood mononuclear cells from breast cancer patients and healthy donors (Lee T V. J Interferon Cytokine Res. 2000 20:391-401). However, in a clinical trial with that MHC Class I peptide only 3/9 patients had lymphocyte proliferative responses that were above baseline following vaccination (Murray J L. Semin Oncol. 2000 27 Suppl: 71-5). Increased CTL proliferation and IFN-ã levels were seen in stimulated cultures of peripheral blood mononuclear cells of only one vaccinated patient. In 3 of 5 patients, IFN-ã and CTL activity were increased significantly by IL-12 addition, indicating that weak antigen presentation leads to weak CTL induction, which is reversed partially in vitro with pro-inflammatory cytokines. However, MHC Class I peptide immunization does not induce helper $CD4^+$ T cell responses. For this reason, peptide vaccines are sought with either only a MHC Class II presented, $CD4^+$ T-helper cell stimulating epitope or with a peptide in which a MHC Class II-presented, CD4+ T-helper cell stimulating epitope overlays a MHC Class I-presented, $CD8^+$ T-cytotoxic cell stimulating epitope.

Peripheral blood mononuclear cells from healthy donors and ovarian cancer patients do respond to Her-2/neu peptides (Fisk B. Anticancer Res. 1997 17:45-53). Peptide sequences from Her-2/neu containing anchors for major human MHC-class II molecules induced proliferative and cytokine responses at a higher frequency in healthy donors than in ovarian cancer patients. Four Her-2/neu peptides of sequences: 396-406, 474-487, 777-789, and 884-899 stimulated proliferation of a larger number of healthy donors than three other distinct HER-2 peptides 449-464, 975-987 and 1086-1098. The pattern of responses of twenty-five ovarian cancer patients was different from that of healthy donors. T cell lines were developed by stimulation with peptides of peripheral blood mononuclear cells of an ovarian cancer patient who showed a stable response to all four Her-2/neu peptides over six months. Each T cell line differed in secretion of IFN-gamma and IL-10. These results demonstrate (a) that Her-2/neu peptides can stimulate expansion of T cells in both healthy donors and ovarian cancer patients, and (b) different peptides induce different cytokine secretion patterns. J Interferon Cytokine Res. 2002 May; 22(5):583-92.

Ioannides and colleagues demonstrated axillary lymph nodes from patients with breast carcinoma respond to HER-2/neu peptides (Kuerer H M. J Interferon Cytokine Res. 2002 22:583-92). Freshly isolated lymphocytes from lymph nodes of 7 women undergoing surgery for invasive breast cancer were stimulated with HER-2/neu peptides at 50 μgm/ml and with control antigens. IFN-γ, IL-4, and IL-10 levels were determined at priming and at restimulation with HER-2/neu peptides. Lymphocytes isolated from the axillary lymph nodes of the patients responded to HER-2/neu peptides, proliferating and specific cytokine production. Proliferative responses to HER-2/neu peptides were seen in lymphocytes of patients with and without overexpression of HER-2/neu in the primary tumor. In some patients, the proliferative response to HER-2/neu peptides in lymphocytes from lymph nodes with metastases was absent or decreased compared to response in lymphocytes from lymph nodes without metastases from the same patient (p<0.05). HER-2/neu peptides induced a predominantly T helper type 1 (Th1) pattern of cytokine response in nodal lymphocytes isolated from breast cancer patients. A Th1-specific cytokine production pattern was maintained at priming and restimulation with HER-2/neu peptides and was amplified with IL-12 costimulation. These results indicate that HER-2/neu peptides can activate T cells in draining lymph nodes from women with invasive breast cancer.

Patients immunized with an HLA-A2-presented, Her-2/neu peptide developed only a low level and short-lived CTL response, in the absence of concurrent vaccination with a MHC Class II-presented epitope (Ward R L. Hum Immunol. 1999 60:510-5). Six HLA-A2 patients with Her-2/neu-overexpressing cancers received 6 monthly vaccinations with a vaccine preparation consisting of 500 μg of Her-2/neu(369-377) peptide, admixed with 100 μg of GM-CSF. The patients had either stage III or IV breast or ovarian cancer. Immune responses to the Her-2/neu(369-377) peptide were examined using an IFN-γ enzyme-linked immunosorbent spot assay. Although HER-2/neu MHC class I epitopes induced HER-2/neu peptide-specific IFN-γ-producing CD8+ T cells, the magnitudes of the responses were low, as well as short-lived, indicating that CD4+ T-cell help is required for robust and lasting immunity to this epitope.

Disis and colleagues immunized with breast cancer patients a HER-2/neu helper peptide vaccine generating HER-2/neu CD8 T-cell immunity (Knutson K L. J Clin Invest. 2001 107:477-84). Nineteen HLA-A2 patients with HER-2/neu-overexpressing cancers received a vaccine preparation consisting of Her-2/neu(369-384), Her-2/neu (688-703), and Her-2/neu(971-984). Contained within these sequences are HLA-A2-binding motifs Her-2/neu(369-377), Her-2/neu(689-697), and Her-2/neu(971-979). After vaccination, the mean peptide-specific T-cell precursor frequency to the HLA-A2 peptides increased in the majority of patients. In addition, the peptide-specific T cells were able to lyse tumors. The responses were long-lived and detected for more than 1 year after the final vaccination in some patients. These results demonstrate that Her-2/neu MHC class II epitopes containing overlaying MHC Class I epitopes induce long-lasting Her-2/neu-specific IFN-γ-producing CD8$^+$ T cells.

Disis and colleagues immunized sixty-four patients with HER-2/neu-overexpressing breast, ovarian, or non-small-cell lung cancers with vaccines composed of peptides derived from potential T-helper epitopes of the HER-2/neu protein mixed with granulocyte-macrophage colony-stimulating factor and administered intradermally (Disis M L. J Clin Oncol. 2002 20:2624-32). Nine different epitopes were used: 3 derived from the intracellular domain of her-2/neu (p776-790, p927-941, and p1166-1180), 3 derived from the extracellular domain of her-2/neu (p42-56, p98-114, and p328-345), and 3 with helper epitopes that encompass in their natural sequence HLA-A2 binding motifs (p369-384, p688-703, and p971-984). Ninety-two percent of patients developed T-cell immunity to HER-2/neu peptides and 68% to a HER-2/neu protein domain. Epitope spreading was observed in 84% of patients and correlated with the generation of a HER-2/neu protein-specific T-cell immunity (P=0.03). At 1-year follow-up, immunity to the HER-2/neu protein persisted in 38% of patients. No patient developed any detected autoimmune toxicity, particularly in organs known to express basal levels of her-2/neu protein including the liver, digestive tract, and skin. The incorporation of MHC Class II epitopes used in this study in Ii-Key hybrid molecules might lead to more rapid anti-her-2/neu immune responses with lower and fewer doses, greater epitope spreading, induction of higher affinity T-cells against tumor, more prolonged immune responses against epitopes and her-2/neu protein, and greater clinical efficacy.

Finding tumor-reactive CTLs in tumor infiltrates and in the peripheral blood of cancer patients, raises the question that any anti-tumor immune response does not control disease spread (Anderson B W. Clin Cancer Res. 2000 6:4192-200). One might then question whether amplification of this response by peptide vaccines is useful during disease progression. Induction of tumor-reactive CTLs in healthy donors at risk, as well as in patients free of disease, has been proposed on the hypothesis that CTLs that recognize tumors early are more effective in containing their progression than CTLs that expand only when the disease progresses. Priming of cytolytic T cell activity in 10 healthy donors was tested with Her-2/neu(369-377) peptide as an immunogen and autologous peripheral blood mononuclear cell-derived dendritic cells as antigen presenting cells. Of those two responded at priming with Her-2/neu(369-377) peptide presented on autologous dendritic cells by induction of Her-2/neu(369-377) peptide-specific CTL activity. Three other responders were identified after two additional restimulations. Induction of cytolytic activity at priming was enhanced in responders by tumor necrosis factor-alpha and IL-12 but not in the non-responders.

Determinant spreading and Th1 responses were induced by in vitro stimulation with Her-2/neu peptides (Anderson B W. Cancer Immunol Immunother. 2000 49:459-68). The induction of a response to Her-2/neu(776-789) induced reactivity to other Her-2/neu peptides. Her-2/neu(776-789) expanded a response to Her-2/neu (884-899) in both an ovarian cancer patient with progressive disease and a healthy donor who shared HLA-DR11. This response was characterized mainly by increased IFN-γ secretion, and proliferation, but did not occur with another donor who shared only HLA-DR14 and HLA-DQ5 with the patient. Epitope spreading can also be enhanced by the coordinated use of Ii-Key/antigenic epitope hybrids immunizations with Ii reverse gene construct, Her-2/neu gene immunizations.

Hess and colleagues found that a chimeric construct of an MHC class II binding peptide from Her-2/neu and the N-terminal flanking region of CLIP elicited potent antitumor activity against a Her-2/neu-positive tumor in a rat model system (Hess A D. Clin Immunol. 2001 101:67-76). Induction of effective antitumor immunity required presentation of the chimeric peptide on irradiated tumor cells or in concert with a Her-2/neu MHC class I-restricted peptide from Her-2/neu. Adoptive transfer studies showed the need for CD4 T helper cells for protective antitumor immunity. Immunization with the epitope-only peptide caused a weak immune response to the unmodified peptide in vitro of both type 1 (IL-2, IFN-γ) and type 2 (IL-4, IL-10) cytokine-producing cells analyzed by RT-PCR (qualitative and quantitative) and by limiting dilution assay. Comparatively, immunization with the chimeric construct elicited a potent immune response to the parent epitope with predominantly type 1 cytokine-producing cells.

Accelerated Her-2/neu degradation enhanced ovarian tumor recognition by CTL (Castilleja A. Mol Cell Biochem. 2001 217:21-33). In those studies, Her-2/neu degradation was enhanced in the ovarian tumor line, SKOV3.A2, that constitutively overexpressed Her-2/neu by the addition of geldanamycin, which down-modulated Her-2/neu from the cell surface and promoted its polyubiquitinylation and degradation.

Presentation of the immunodominant cytotoxic T lymphocyte (CTL) epitope, Her-2/neu(369-377) from SKOV.A2 was inhibited by proteosome inhibitors, such as LLnL. Additional experiments indicated that the newly synthesized Her-2/neu in the presence of GA was the main source of epitopes recognized by CTL. Twenty-hour GA-treated SKOV3.A2 cells were better inducers of CTL activity directed to a number of Her-2/neu CTL epitopes, in peripheral blood mononuclear cells compared with control untreated SKOV3.A2 cells thereby promoting immunogenecity. Similarly geldanamycin and other compounds acting by a similar mechanism, are expected to enhance binding of MHC Class II epitopes in the ER in the absence of Ii protein.

Ward and colleagues used phage-displayed ErbB-2 gene fragment libraries and synthetic peptides to epitope-map a panel of anti-Her-2/neu monoclonal antibodies (Yip Y L. Cancer Immunol Immunother. 2002 50:569-87; Yip Y L. J Immunol. 2001 166:5271-8). The epitopes of three monoclonal antibodies, N12, N28, and L87, were successfully located to Her-2/neu(C531-A586), Her-2/neu(T216-C235), and Her-2/neu(C220-C235) of Her-2/neu, respectively. It was found that while N12 inhibited tumor cell proliferation, N28 stimulated the proliferation of a subset of breast cancer cell lines over-expressing Her-2/neu. The peptide region recognized by N12, Her-2/neu(C531-A586), was used as an immunogen to selectively induce an inhibitory immune response in mice. Mice immunized with the GST fusion peptide, GST-Her-2/neu(C531-A586), recognized native Her-2/neu, the peptide Her-2/neu(531-586), three 15-amino acid peptides of Her-2/neu(533-548), Her-2/neu(545-5560), and Her-2/neu (571-586). More importantly, immunoglobulins purified from mouse sera were able to inhibit up to 85% of tumor cell proliferation. This study supports the use of some of the potential antibody recognized determinants in the construction of Ii-Key/Her-2/neu MHC Class II-presented antigenic epitope/antibody-recognized determinant hybrids. The antibody recognized determinants are presented in Table 16.8 and hybrids containing those epitopes are presented in Table 16.9. Such hybrids containing antibody-recognized determinants might be preferred can be used for the development of both passive and active immunotherapies of Her-2/neu over-expressing tumors.

Given the experimentally identified MHC Class II-presented epitopes (above) such epitope can be synthesized within Ii-Key/Her-2/neu antigenic epitope hybrids for stimulation of a diagnostic or therapeutic immune response.

The amino acid sequence of human Her-2/neu protein [*Homo sapiens*](gi|19575768|) was obtained from GenBank (Table 16.1). An important consideration in the selection of peptides for cancer immunotherapy is the high degree of sequence homology between Her-2/neu and another member of the subclass I family of growth factor receptor (EGF-r) (Lustgarten J. Hum Immunol. 1997 52:109-18). Unlike Her-2/neu, the EGF-r is widely expressed in the body. Peptide sequences identical between Her-2/neu and the mouse or human EGF-r were not selected for two reasons. First, it is likely that T-cell tolerance to such sequences would have eliminated from the repertoire high affinity T cells with specificity for such epitopes. Second, it would be undesirable to target CTL against normal cell expressing EGF-r peptides.

TABLE 25.1

Deduced amino acid sequence (SEQ ID NO.: 930) of Her-2/neu.

```
  1  melaalcrwg lllallppga astqvctgtd mklrlpaspe thldmlrhly
 51  qgcqvvqgnl eltylptnas lsflqdiqev qgyvliahnq vrqvplqrlr
101  ivrgtqlfed nyalavldng dplnnttpvt gaspgglrel qlrslteilk
151  ggvliqrnpq lcyqdtilwk difhknnqla ltlidtnrsr achpcspmck
201  gsrcwgesse dcqsltrtvc aggcarckgp lptdccheqc aagctgpkhs
251  dclaclhfnh sgicelhcpa lvtyntdtfe smpnpegryt fgascvtacp
301  ynylstdvgs ctlvcplhnq evtaedgtqr cekcskpcar vcyglgmehl
351  revravtsan iqefagckki fgslaflpes fdgdpasnta plqpeqlqvf
401  etleeitgyl yisawpdslp dlsvfqnlqv irgrilhnga ysltlqglgi
451  swlglrslre lgsglalihh nthlcfyhtv pwdqlfrnph qallhtanrp
501  edecvgegla chqlcarghc wgpgptqcvn csqflrgqec veecrvlqgl
551  preyvnarhc lpchpecqpq ngsvtcfgpe adqcvacahy kdppfcvarc
601  psgvkpdlsy mpiwkfpdee gacqpcpinc thscvdlddk gcpaeqrasp
651  ltsiisavvg illvvvlgvv fgilikrrqq kirkytmrrl lqetelvepl
701  tpsgampnqa qmrilketel rkvkvlgsga fgtvykgiwi pdgenvkipv
751  aikvlrents pkankeilde ayvmagvgsp yvsrllgicl tstvqlvtql
801  mpygclldhv renrgrlgsq dllnwcmqia kgmsyledvr lvhrdlaarn
851  vlvkspnhvk itdfglarll dideteyhad ggkvpikwma lesilrrrft
901  hqsdvwsygv tvwelmtfga kpydgipare ipdllekger lpqppictid
951  vymimvkcwm idsecrprfr elvsefsrma rdpqrfvviq nedlgpaspl
```

TABLE 25.1-continued

Deduced amino acid sequence (SEQ ID NO.: 930) of Her-2/neu.

```
1001  dstfyrslle  dddmgdlvda  eeylvpqqgf  fcpdpapgag  gmvhhrhrss 1051  strsgggdlt  lglepseeea  prsplapseg  agsdvfdgdl  gmgaakglqs 1101  lpthdpsplq  rysedptvpl  psetdgyvap  ltcspqpeyv  nqpdvrpqpp 1151  spregplpaa  rpagatlerp  ktlspgkngv  vkdvfafgga  venpeyltpq 1201  ggaapqphpp  pafspafdnl  yywdqdpper  gappstfkgt  ptaenpeylg 1251  ldvpvcid   in the antigenic epitope.
```

Sequence is the amino acid sequence of the predicted MHC Class II-presented epitope. Score is the score reported by the ProPred program, for high scoring selections with multiple common HLA-DR alleles. Ii-Key is the number of residue positions intervening between an Ii-Key motif and the first residue of the antigenic epitope.

TABLE 25.2

Ii-key/human Her-2/neu epitope hybrids.

| Peptide | Peptide | N-term | Epitope | C-term | SEQ ID NO |
|---|---|---|---|---|---|
| 25.2.1 | AE-Her-36 | Ac— | GVGSPYVSRLLGICL | $—NH_2$ | 908 |
| 25.2.2 | AE-Her-37 | Ac-LRMK- | GVGSPYVSRLLGICL | $—NH_2$ | 931 |
| 25.2.3 | AE-Her-39 | Ac-LRMK-ava- | GVGSPYVSRLLGICL | $—NH_2$ | 932 |
| 25.2.4 | AE-Her-48 | Ac-LRMK-ava- | VGSPYVSRLLGICL | $—NH_2$ | 933 |
| 25.2.5 | AE-Her-47 | Ac-LRMK-ava- | GSPYVSRLLGICL | $—NH_2$ | 934 |
| 25.2.6 | AE-Her-38 | Ac-LRMK-ava- | SPYVSRLLGICL | $—NH_2$ | 935 |

TABLE 25.3

In vitro IFN-γ immune response with normal donor (DR0701) PBMC stimulated with Ii-Key/HER-2/neu (776-790) hybrids or HER-2/neu (776-790) epitope only.

| Peptide | Peptide | IFN-γ spots unpulsed | IFN-γ spots pulsed |
|---|---|---|---|
| 25.3.1 | AE-Her-36 | 4 | 100 |
| 25.3.2 | AE-Her-37 | 65 | 560 |
| 25.3.3 | AE-Her-39 | 24 | 160 |
| 25.3.4 | AE-Her-48 | 212 | 1770 |
| 25.3.5 | AE-Her-47 | 23 | 380 |
| 25.3.6 | AE-Her-38 | 27 | 210 |

Total PBMC were stimulated in vitro for 12 days in the presence of various Ii-Key/Her (776-790) hybrids or Her (776-790) epitope-only (50 μg/ml). Ten U/ml IL-2 and 0.2 to 2 ng/ml of IL-12 were added on days 4 and 8 and the cells were further incubated for 4 days. Viable cell yield was assessed on day 12, and IFN-γ ELISPOT assay (3 day format) was used to determine frequencies of peptide specific T-cells. On day 1 of the IFN-γ ELISPOT assay, T cells from replicate wells were plated into a 96 well pre-coated IFN-γ plate. On day 2, the cells were restimulated with autologous pulsed or unpulsed irradiated PBMC with Ii-Key/Her hybrids or epitope only (25 μg/ml). The cells were further incubated for 24 hours and detection of IFN-γ cytokine response was completed.

Ii inhibition in MHC class I+, MHC class II+ cells leads to the presentation of endogenous proteins' antigenic epitopes, which in the absence of Ii protein have become bound in the ER to both MHC class I and class II molecules. Epitope presentation by MHC class II molecules activates CD4+ T cells, thereby potentiating greater activation of CD8+ T cells. In the case of DC, such a mechanism of action greatly potentiates various method of dendritic cells (DC)-based tumor DNA or RNA vaccines and immunotherapy, e.g., the ex vivo expansion of antigen-specific T cells.

Various reverse gene constructs were created coding for expression of polyribonucleotides, which are complementary in a reverse orientation to the mRNA for the Ii protein of humans and the mouse. Such constructs in either plasmids or adenoviral vectors suppress Ii expression in various murine cultured tumor cells and established tumors. Constructs for human Ii RGC also suppressed Ii protein expression in human HeLa cervical carcinoma cells, Raji Burkitt's lymphoma cells, melanoma Zeuthen 18363 cells, and DU145 prostate cancer cells.

Another application is enhancement of the responses of anti-tumor T cells, is with Ii-Key/MHC class II epitope hybrid peptides. MHC-presented peptide vaccines are a most promising therapy for melanoma. However, MHC class I peptides that prime cytotoxic T lymphocytes (CTL) lack dramatic anti-tumor effect in clinical trials. Co-immunization with MHC class II peptides substantially enhances CTL potency and provides memory. A drawback to this approach is that MHC class II epitopes bind poorly, and therefore they are weak immunogens. Antigen Express scientists found that hybrid peptides linking an immunoregulatory segment of the Ii protein (Ii-Key peptide) through a polymethylene bridge to a MHC class II epitope enhances the potency of class II epitope presentation 200 times more than the epitope-only peptide in vitro. Immunizing mice with such hybrids demonstrates 4-6 times enhancement of Th1 cells by with Ii-Key/

MHC class II HIV epitope hybrid than HIV epitope-alone peptide, as measured by ELISPOT. In vitro Ii-Key/HER-2/neu(MHC II epitope) hybrids potently stimulate peripheral blood or draining lymph node lymphocytes from breast cancer patients. Applying these methods to melanoma, it was shown that immunizing HLA-DR4-IE transgenic mice with Ii-Key/gp100(46-58) hybrids generated enhancement of Th1 activation as measured by IFN-ELISPOT when compared to the gp100(46-58) epitope alone. Overall, the Ii-key/gp100 (46-58) hybrids elicited higher frequencies of responding cells and stronger cytokine output per cell, in a manner paralleling studies of the effects of signal strength in eliciting effector functions.

Baxevanis and colleagues have studied responses of lymphocytes of patients with breast cancer carcinoma to HER-2/neu MHC class II epitopes, defining responses to HER-2/neu (776-790). They have shown that HER-2/neu (776-790) is a naturally processed MHC class II epitope with broad specificity. At the clonal level HER-2/neu (776-790) is capable of specifically activating CD4+ T-cells to proliferate and secrete IFN-γ (Br. J. Cancer. 2001 85:1527-34). These results correlate with those of Ioannides et al. (Anticancer Res. 2002 22:1481-90). Furthermore, T-cells of 10 of 18 patients with metastatic breast carcinoma recognized HER-2 (777-789) in cultures with a Th1 cytokine profile (J. Interferon Cytokine Res. 2002 22:583). Ioannides et al. have also shown stronger and prolonged CTL lysis in PBMC primed with HER-2/neu (776-790) followed by stimulation with HER-2/neu (369-377) HLA-A2-restricted. Baxevanis et al. further illustrated that in vitro restimulation of PBMC with HER-2/neu (776-790) expanded the immune response to another epitope HER-2/neu (884-899) in both an ovarian cancer patient with progressive disease and a healthy donor (HLA-DR11) (Cancer Immunol. Immunother. 2002 50:615-24). Similarly, Disis et al. conducted immunizations trials of patients with HER-2/neu (776-790), and the majority of patients completing all vaccinations developed HER-2/neu peptide and protein responses with epitope spreading (J. Clinical. Oncol. 2002. 20:2624-32). Recently, Baxevanis et al. have shown that patients with colorectal, lung and prostate cancers have a pre-existing immunity to HER-2/neu (369-377) HLA-A2-restricted epitope which is also recognized in the context of HLA-A3 and HLA-26 (Br. J. Cancer. 2003. 89:1055-61). In addition, Baxevanis et al. demonstrated for the first time that patients with HER-2/neu (+) tumors have pre-existing immunity to several other HER-2/neu MHC class I epitopes: HER-2(435), HER-2 (952), and HER-2(689) (Cancer Immunol. Immunother. 2003 52:771-779). These results broaden the potential application of HER-2/neu-based immunotherapy and can be combined with the Ii-key technology to approach maximal clinical therapeutic effect. Furthermore, adoptive transfer immunotherapy of T-cells expanded in vitro with a combination of Ii-key/MHC class II hybrids and MHC class I-HER-2/neu epitopes may provide prolonged and sustained immunity in cancer patients with HER-2+ tumors.

In extension of the experiments reported above, one can evaluate the activity of antigen specific CD4 T cells recognizing HER-2/neu associated antigens using in vitro stimulation with Ii-key/MHC class II epitope hybrids. To achieve this objective, PBMC of patients with various types of HER-2+ tumors, e.g., ovarian, colorectal, small lung, prostate, etc., will be stimulated in vitro with irradiated autologous APC pulsed with the Ii-key HER-2/neu (776-790) hybrids versus HER-2/neu (776-790) free epitope. The enhancement of antigen specific response in bulk CD4+ cultures stimulated with Ii-key hybrids as compared to free epitope will be assessed via cellular proliferation, IFN-gamma, IL-4, and/or other cytokine ELISPOT or ELISA readouts.

Alternatively, PBMC may be incubated with autologous DC pulsed with Ii-key/hybrids or epitope-only peptides to generate antigen-specific CD4+ T cells using CD4-selected PBMC from DR4+ individuals. Antigen specific CD4+ T-cell lines generated from cultures pulsed with irradiated hybrid versus peptide only-loaded autologous PBMC or DC will be tested for their ability to recognize naturally processed and presented Her-2/neu (776-790) peptide or hybrids on tumor cells induced to express HLA-DR alleles by IFN-gamma treatment or stable transfection with DR4 alleles and Her-2/neu cDNA.

Example 26

Ii-Key/HIV Gag MHC Class II Antigenic Epitope Hybrids

A potent T helper cell stimulating activity is obtained by incorporating a MHC class II epitope into an Ii-Key hybrid peptide of structure: Ac-LRMK-5-aminopentanoyl-antigenic epitope-NH$_2$. The 5-aminopentanoic acid residue (δ-amino-n-valeric acid) is a flexible linker of approximately the length of the backbone of a tripeptidyl unit. The optimal spacing (by either amino acids or a synthetic linker) between the Ii-key and an epitope will be determined with various Ii-Key/HIV Gag MHC class II epitope hybrid peptide constructs through in vitro ELISPOT assays with blood samples of HIV-1 infected subjects and using frequently targeted HIV-1 epitopes. Kaufmann et al. identified several Gag and Nef peptides broadly targeted by individuals with various HLA-DR alleles. Fine mapping, restriction and binding studies confirmed the presence of promiscuous epitopes presented by various HLA class II molecules. Ii-Key/HIV gag MHC class II epitope hybrid peptides based on these frequently recognized sequences may be good candidates for vaccine development. Defective CD4$^+$ T cell responses are thought to be essential in HIV pathogenesis. Defects include defective lymphocyte proliferative responses, which has been linked to a lack of IL-2 secretion. The impairment of CD4 help is likely to contribute to CD8 cell functional defects, which include poor proliferation and defective killing functions that are maintained in cells of long-term non-progressors.

The most frequently targeted epitopes within these 2 Gag peptides are NKIVRMYSPTSI (SEQ ID NO.: 936) and RFYKTLRAEQASQ (SEQ ID NO.: 937). The peptides to be tested will have the structure Ac-LRMK-ava-peptide-NH$_2$ (LRMK disclosed as SEQ ID NO: 9), with peptide corresponding to serial truncations at the N-terminus of Gag 265-282 or Gag 296-313 (Tables 26.1 and 26.2). Responses restricted by HLA-DRB1*0401 and HLA-DRB1*1501 will be of special interest. The hybrid constructs, the natural Glade B peptides and the autologous peptide (when available) will be tested in serial dilutions in IFN-gamma Elispot and CFSE-based proliferation assays. For the strongest responses, profile of cytokine secretion (IFN-γ, IL-2, TNF-γ, IL-4 or IL-10) will be tested by flow cytometry (LSRII; Becton Dickinson) or by Elispot assays. Sensitivity and reliability of the latter for cytokines other then IFN-γ will be assessed. Responses restricted by DRB1*0401 or DRB1*1501 will be further by MHC class II tetramers (Beckman Coulter).

If some hybrid constructs are shown to be more potent that the natural peptide, THEY will be further assessed in its ability to provide help for CD8$^+$ proliferation (in CFSE-based assays) and to generate epitope-specific CD4$^+$ cell lines.

Related experiments can be done with rhesus macaques. a) HIV-1 or SIV recombinant virus vaccinated rhesus macaques with various HLA-DR alleles, in whom responses to p24 peptides Gag 265-282 or Gag 296-313 are likely. These subjects will be tested to identify the optimal hybrid construct, in particular the optimal length of the linker sequence and N-terminal extension of amino acids from a putative MHC class II-presented epitope, enhancing responses to previously well characterized epitopes. b) HIV-1 or SIV recombinant virus vaccinated rhesus macaques with various HLA-DR alleles, in whom responses to p24 peptides Gag 265-282 or Gag 296-313 have not been demonstrated by IFN-γ Elispot or CFSE-based proliferation assays. These subjects will be tested in order to assess the capacity of the hybrids to generate potential de novo responses in vitro.

TABLE 26.1

Homologous peptides of HIV Gag p24 (133-150).

| Peptide # | AE# | EPI SEQ N-term | SEQ | C-term | SEQ ID NO |
|---|---|---|---|---|---|
| 26.1.1 | AE-K1 | | WIILGLNKIVRMYSPTSI | | 938 |
| 26.1.2 | AE-K2 | | WIILGLNKIVRM | | 939 |
| 26.1.3 | AE-K3 | | ILGLNKIVRMY | | 940 |
| 26.1.4 | AE-K4 | | NKIVRMYSPTSI | | 936 |
| 26.1.5 | AE-P1 | Ac-LRLK-ava- | WIILGLNKIVRMYSPTSI | —$NH_2$ | 941 |
| 26.1.6 | AE-P2 | Ac-LRLK-ava- | IILGLNKIVRMYSPTSI | —$NH_2$ | 942 |
| 26.1.7 | AE-P3 | Ac-LRLK-ava- | ILGLNKIVRMYSPTSI | —$NH_2$ | 943 |
| 26.1.8 | AE-P4 | Ac-LRLK-ava- | LGLNKIVRMYSPTSI | —$NH_2$ | 944 |
| 26.1.9 | AE-P5 | Ac-LRLK-ava- | GLNKIVRMYSPTSI | —$NH_2$ | 945 |
| 26.1.10 | AE-P6 | Ac-LRLK-ava- | LNKIVRMYSPTSI | —$NH_2$ | 946 |
| 26.1.11 | AE-P7 | Ac-LRLK-ava- | NKIVRMYSPTSI | —$NH_2$ | 947 |
| 26.1.12 | AE-P8 | Ac-LRLK-ava- | KIVRMYSPTSI | —$NH_2$ | 948 |
| 26.1.13 | AE-P9 | Ac-LRLK-ava- | IILGLDKIVRMYSPTSI | —$NH_2$ | 949 |

-ava- = delta aminovaleric acid = 5-aminopentanoic acid

TABLE 26.2

Homologus peptides of HIV Gag p24 (164-181).

| Peptide # | AE# | EPI SEQ N-term | SEQ | C-term | SEQ ID NO |
|---|---|---|---|---|---|
| 26.2.1 | AE-K1 | | YVDRFYKTLRAEQASQEV | | 950 |
| 26.2.2 | AE-P31 | Ac-LRLK-ava- | YVDRFYKTLRAEQASQEV | —$NH_2$ | 951 |
| 26.2.3 | AE-P32 | Ac-LRLK-ava- | VDRFYKTLRAEQASQEV | —$NH_2$ | 952 |
| 26.2.4 | AE-P33 | Ac-LRLK-ava- | DRFYKTLRAEQASQEV | —$NH_2$ | 953 |
| 26.2.5 | AE-P34 | Ac-LRLK-ava- | RFYKTLRAEQASQEV | —$NH_2$ | 954 |
| 26.2.6 | AE-P35 | Ac-LRLK-ava- | FYKTLRAEQASQEV | —$NH_2$ | 955 |
| 26.2.7 | AE-P36 | Ac-LRLK-ava- | YKTLRAEQASQEV | —$NH_2$ | 956 |
| 26.2.8 | AE-P37 | Ac-LRLK-ava- | VDRFYKTLRAEEASQEV | —$NH_2$ | 957 |
| 26.2.9 | AE-P38 | Ac-LRLK-ava- | VDRFYKTLRAEQASEEV | —$NH_2$ | 958 |
| 26.2.10 | AE-P39 | Ac-LRLK-ava- | VDRFYKTLRAEEASEEV | —$NH_2$ | 959 |
| 26.2.11 | AE-P40 | Ac— | VDRFYKTLRAEQASQEV | —$NH_2$ | 960 |
| 26.2.12 | AE-P41 | Ac— | RFYKTLRAEQASQEV | —$NH_2$ | 961 |
| 26.2.13 | AE-P42 | Ac-LRLK-ava- | FYKTLRAEQASQEV | —$NH_2$ | 962 |

-ava- = delta aminovaleric acid = 5-aminopentanoic acid

TABLE 26.3

Homologus peptides of HIV Gag p24(121-138).

| Peptide # | AE # | 1st aa N-term | SEQUENCE | C-term | SEQ ID NO |
|---|---|---|---|---|---|
| 26.3.1 | G1 | 251Ac-LMRK-ava | NNPPIPVGEIYKRWIILGL | -NH₂ | 963 |
| 26.3.2 | G2 | 252Ac-LMRK-ava | NPPIPVGEIYKRWIILGL | -NH₂ | 964 |
| 26.3.3 | G3 | 253Ac-LMRK-ava | PPIPVGEIYKRWIILGL | -NH₂ | 965 |
| 26.3.4 | G4 | 254Ac-LMRK-ava | PIPVGEIYKRWIILGL | -NH₂ | 966 |
| 26.3.5 | G5 | 255Ac-LMRK-ava | IPVGEIYKRWIILGL | -NH₂ | 967 |
| 26.3.6 | G6 | 256Ac-LMRK-ava | PVGEIYKRWIILGL | -NH₂ | 968 |
| 26.3.7 | G7 | 257Ac-LMRK-ava | VGEIYKRWIILGL | -NH₂ | 969 |
| 26.3.8 | G8 | 258Ac-LMRK-ava | GEIYKRWIILGL | -NH₂ | 970 |
| 26.3.9 | G9 | 259Ac-LMRK-ava | EIYKRWIILGL | -NH₂ | 971 |
| 26.3.10 | G10 | 260Ac-LMRK-ava | IYKRWIILGL | -NH₂ | 972 |
| 26.3.11 | G11 | 260Ac-LMRK-ava | YKRWIILGL | -NH₂ | 973 |
| 26.3.12 | G12 | 258Ac— | GEIYKRWIILGL | -NH₂ | 974 |
| 26.3.13 | G13 | 258Ac-LMRK-ava-ava- | GEIYKRWIILGL | -NH₂ | 975 |
| 26.3.14 | G14 | 260Ac-LMRK-ava-ava- | IYKRWIILGL | -NH₂ | 976 |
| 26.3.15 | G15 | 261Ac— | GEIYKRWIILGL | -NH₂ | 977 |

-ava- = delta aminovaleric acid = 5-aminopentanoic acid

While the above series of Ii-Key/HIV Gag MHC class II epitope peptides were designed around promiscuous regions, the series of Ii-Key hybrids containing epitopes predicted from an algorithm are useful in a murine immunization model.

Gag polyprotein precursor" PID g327745"
(SEQ ID NO.: 978)
MGARASVLSGGELDRWEKIRLRPGGKKKYKLKHIVWASRELERF
AVNPGLLETSEGCRQILGQLQPSLQTGSEELRSLYNTVATLYCVHQRIEI
KDTKEALDKIEEEQNKSKKKAQQAAADTGHSNQVSQNYPIVQNIQGQMVH
QAISPRTLNAWVKVVEEKAFSPEVIPMFSALSEGATPQDLNTMLNTVGGH
QAAMQMLKETINEEAAEWDRVHPVHAGPIAPGQMREPRGSDIAGTTSTLQ
EQIGWMTNNPPIPVGEIYKRWIILGLNKIVRMYSPTSILDIRQGPKEPFR
DYVDRFYKTLRAEQASQEVKNWMTETLLVQNANPDCKTILKALGPAATLE
EMMTACQGVGGPGHKARVLAEAMSQVTNSATIMMQRGNFRNQRKIVKCFN
CGKEGHTARNCRAPRKKGCWKCGKEGHQMKDCTERQANFLGKIWPSYKGR
PGNFLQSRPEPTAPPEESFRSGVETTTPPQKQEPIDKELYPLTSLRSLFG
NDPSSQ

TABLE 26.4

Rammensee-algorithm selected Gag epitopes.

|   | 0101 | 0301 | 0401 | 0701 | 1101 | 1501 | Eᵏ |
|---|---|---|---|---|---|---|---|
| 1 | 298 | 18 | 72 | 367 | 267 | 10 | 32 |
| 2 | 486 | 57 | 101 | 168 | 152 | 166 | 279 |
| 3 | 185 | 153 | 140 | 198 | 13 | 271 | 28 |
| 4 | 262 | 90 | 168 | 274 | 129 | 310 | 264 |
| 5 | 132 | 282 | 267 | 481 | 209 | 149 | 294 |
| 6 | 209 | 10 | 279 | 64 | 298 | 38 | 431 |
| 7 | 212 | 177 | 360 | 233 | 434 | 73 | 4 |
| 8 | 328 | 323 | 364 | 310 | 255 | 125 | 16 |
| 9 | 480 | 4 | 480 | 312 | 264 | 155 | 47 |
| 10 | 270 | 47 | 76 | 365 | 327 | 247 | 65 |
| 11 | 152 | 91 | 83 | 47 | 428 | 294 | 101 |
| 12 | 165 | 31 | 129 | 75 | 480 | 295 | 373 |
| 13 | 72 | 75 | 152 | 91 | 483 | 344 | 386 |
| 14 | 438 | 263 | 169 | 132 | 72 | 367 | 48 |
| 15 | 89 | 278 | 209 | 140 | 83 | 374 | 61 |
| 16 | 225 | 310 | 262 | 145 | 165 | 480 | 72 |
| 17 | 271 | 61 | 297 | 157 | 181 | 483 | 82 |
| 18 | 330 | 65 | 298 | 245 | 380 | 4 | 98 |
| 19 | 153 | 72 | 313 | 255 | 185 | 32 | 132 |
| 20 | 155 | 195 | 31 | 263 | 244 | 79 | 153 |
| 21 | 267 | 198 | 57 | 272 | 270 | 126 | 166 |
| 22 | 2 | 264 | 58 | 290 | 297 | 206 | 185 |
| 23 | 168 | 279 | 61 | 334 | 486 | 258 | 212 |
| 24 | 246 | 289 | 79 | 336 | 149 | 259 | 486 |
| 25 | 331 | 430 | 82 | 360 | 186 | 264 | 146 |
| 26 | 76 | 446 | 98 | 32 | 246 | 265 | 252 |
| 27 | 230 | 474 | 131 | 39 | 262 | 267 | 253 |
| 28 | 247 | 482 | 132 | 89 | 435 | 273 | 261 |
| 29 | 255 | 32 | 165 | 98 | 10 | 314 | 320 |
| 30 | 310 | 68 | 185 | 123 | 12 | 334 | 350 |
| 31 | 367 | 85 | 195 | 152 | 26 | 387 | 377 |
| 32 | 373 | 98 | 198 | 153 | 76 | 16 | 464 |
| 33 | 477 | 101 | 212 | 72 | 136 | 30 | 38 |
| 34 | 483 | 131 | 233 | 76 | 169 | 41 | 58 |
| 35 | 57 | 149 | 255 | 83 | 211 | 48 | 79 |

TABLE 26.4-continued

Rammensee-algorithm selected Gag epitopes.

| | 0101 | 0301 | 0401 | 0701 | 1101 | 1501 | $E^k$ |
|---|---|---|---|---|---|---|---|
| 36 | 58 | 161 | 263 | 259 | 383 | 58 | 129 |
| 37 | 135 | 181 | 270 | 262 | 467 | 72 | 152 |
| 38 | 189 | 244 | 310 | 293 | 18 | 89 | 169 |
| 39 | 240 | 255 | 320 | 297 | 25 | 101 | 255 |
| 40 | 244 | 290 | 330 | 330 | 31 | 132 | 267 |
| 41 | 281 | 294 | 331 | 420 | 104 | 140 | 298 |
| 42 | 318 | 319 | 334 | 438 | 154 | 158 | 331 |
| 43 | 356 | 364 | 340 | 446 | 294 | 165 | 367 |
| 44 | 431 | 372 | 343 | 10 | 353 | 168 | 387 |
| 45 | 461 | 374 | 359 | 13 | 401 | 181 | 434 |
| 46 | 141 | 386 | 367 | 30 | 444 | 184 | |
| 47 | 259 | 420 | 386 | 33 | 473 | 185 | |
| 48 | 16 | 434 | 431 | 57 | 7 | 188 | |
| 49 | 26 | 20 | 476 | 117 | 14 | 198 | |
| 50 | 40 | 50 | 483 | 129 | 28 | 212 | |

TABLE 26.5

Highest HLA-DR ranking Ramensee epitopes of Gag.

| | 0101 | 0301 | 0401 | 0701 | 1101 | 1501 | $E^k$ |
|---|---|---|---|---|---|---|---|
| 298 | 1 | | 1, 17 | 39 | 6, 22 | | 41 |
| 18 | 48 | 1 | | | 38 | 32 | 8 |
| 72 | 13 | 19 | 2 | 33 | 14 | 7, 37 | 16 |
| 367 | 31 | | 46 | 1 | | 14 | 43 |
| 267 | 21 | | 5 | | 1 | 27 | 40 |
| 10 | | | | 44 | 29 | 1 | |
| 486 | 2 | | | | 23 | | 24 |
| 57 | 35 | 2 | 21 | 49 | | 36 | 34 |
| 101 | | 33 | 2 | 26 | | 39 | |
| 168 | | | 4, 29 | 2 | 34 | 2, 44 | 21, 38 |
| 152 | 19 | 3 | 13 | 32, 31 | 2 | 9 | 20 |
| 166 | 23 | | 4, 29 | 2 | 16 | 2, 42, 44 | 21 |
| 185 | 3 | | 30 | | 25 | 46, 47 | 22 |
| 153 | 19 | 3 | 13 | 31, 32 | 2, 42 | 9 | 20, 37 |
| 140 | | | 3 | 15 | | 41 | |
| 198 | | 21 | 32 | 3 | | | |
| 13 | | | | | 3, 49 | 35 | |
| 271 | 10, 17 | | 37 | 21 | 21 | 3, 28 | |
| 262 | 4 | 14, 22 | 16, 36 | 20, 37 | 27 | 25 | 4 |
| 90 | | 4 | | | | | |
| 168 | | | 4, 14 | 2 | 34 | 2, 44 | 21, 38 |
| 274 | | | | 4, 21 | | 28 | |
| 129 | | 34 | 12, 27 | 50 | 4 | 4 | 36 |
| 310 | 30 | 16 | 38 | | | 4 | |
| 132 | 5 | 34 | 27, 28 | 14 | | 40 | 18 |
| 282 | 41 | 5 | | | | | |
| 267 | | | 5 | | | 27 | 40 |
| 64 | | 18 | | 5 | | | |
| 298 | | | 17 | 39 | 5 | | 41 |
| 38 | | | | 27 | | 5 | 33 |

TABLE 26.6

Ii-Key/HIV Gag MHC Class II Epitope Hybrid Peptides

| AE | gag | N-term | f-N | Epitope | f-C | C-term | LIV | FM | NQ | C | Syn | SEQ NO |
|---|---|---|---|---|---|---|---|---|---|---|---|---|
| | 298 | Ac— | LRMK-ava | YV | DRFYKTLRA | EQ | —NH$_2$ | 3 | 0 | | Y | 979 |
| | 18 | Ac— | LRMK-ava | WE | KIRLRPGGK | KK | —NH$_2$ | 2 | 0 | | Y | 980 |
| | 72 | Ac— | LRMK-ava | TG | SEELRSLYN | TV | —NH$_2$ | 2 | 1 | | Y | 981 |
| | 367 | Ac— | LRMK-ava | EA | MSQVTNSAT | IM | —NH$_2$ | 2 | 2 | | Y | 982 |
| | 267 | Ac— | LRMK-ava | WI | ILGLNKIVR | MY | —NH$_2$ | 6 | 1 | | N | 983 |
| | 10 | Ac— | LRMK-ava | LS | GGELDRWEK | IR | —NH$_2$ | 2 | 0 | | YO | 984 |
| | 486 | Ac— | LRMK-ava | YP | LTSLRSLFG | ND | —NH$_2$ | 4 | 0 | | Y | 985 |
| | 57 | Ac— | LRMK-ava | EG | CRQILGQLQ | PS | —NH$_2$ | 3 | 3 | 1 | Y | 986 |
| | 101 | Ac— | LRMK-ava | EA | LDKIEEEQN | KS | —NH$_2$ | 2 | 2 | | Y | 987 |
| | 168 | Ac— | LRMK-ava | PE | VIPMFSALS | EG | —NH$_2$ | 5 | 0 | | N | 988 |
| | 152 | Ac— | LRMK-ava | RT | LNAWVKVVE | EK | —NH$_2$ | 4 | 1 | | Y | 989 |
| | 166 | Ac— | LRMK-ava | FS | PEVIPMFSA | LS | —NH$_2$ | 5 | 0 | | YO | 990 |
| | 185 | Ac— | LRMK-ava | DL | NTMLNTVGG | HQ | —NH$_2$ | 4 | 2 | | Y | 991 |

TABLE 26.6-continued

Ii-Key/HIV Gag MHC Class II Epitope Hybrid Peptides

| AE | gag N-term | f-N | Epitope | f-C | C-term | LIV | FM | NQ | CSyn | SEQ NO |
|---|---|---|---|---|---|---|---|---|---|---|
| 153 | Ac— | LRMK-ava | TL | NAWVKVVEE | KA | —NH$_2$ | 4 | 1 | Y | 992 |
| 140 | Ac— | LRMK-ava | IQ | GQMVHQAIS | PR | —NH$_2$ | 4 | 1 | Y | 993 |
| 198 | Ac— | LRMK-ava | AA | MQMLKETIN | EE | —NH$_2$ | 4 | 2 | Y | 994 |
| 13 | Ac— | LRMK-ava | GE | LDRWEKIRL | RP | —NH$_2$ | 3 | 0 | YO | 995 |
| 271 | Ac— | LRMK-ava | GL | NKIVRMYSP | TS | —NH$_2$ | 4 | 0 | Y | 996 |
| 262 | Ac— | LRMK-ava | EI | YKRWIILGL | NK | —NH$_2$ | 5 | 0 | N | 997 |
| 90 | Ac— | LRMK-ava | VH | QRIEIKDTK | EA | —NH$_2$ | 3 | 1 | Y | 998 |
| 168 | Ac— | LRMK-ava | PE | VIPMFSALS | EG | —NH$_2$ | 5 | 0 | N | 999 |
| 274 | Ac— | LRMK-ava | KI | VRMYSPTSI | LD | —NH$_2$ | 4 | 0 | Y | 1000 |
| 129 | Ac— | LRMK-ava | QV | SQNYPIVQN | IQ | —NH$_2$ | 4 | 1 | YO | 1001 |
| 310 | Ac— | LRMK-ava | QA | SQEVKNWMT | ET | —NH$_2$ | 2 | 2 | Y | 1002 |
| 132 | Ac— | LRMK-ava | QN | YPIVQNIQG | QM | —NH$_2$ | 4 | 1 | YO | 1003 |
| 282 | Ac— | LRMK-ava | TS | ILDIRQGPK | EP | —NH$_2$ | 3 | 0 | Y | 1004 |
| 267 | Ac— | LRMK-ava | WI | ILGLNKIVR | MY | —NH$_2$ | 7 | 1 | N | 1005 |
| 481 | Ac— | LRMK-ava | ID | KELYPLTSL | RS | —NH$_2$ | 4 | 0 | Y | 1006 |
| 209 | Ac— | LRMK-ava | EE | AAEWDRVHP | VH | —NH$_2$ | 2 | 0 | Y | 1007 |
| 149 | Ac— | LRMK-ava | SP | PRTLNAWVK | VV | —NH$_2$ | 4 | 1 | Y | 1008 |

Overlapping groups: (267, 267), (10, 13), (168, 166, 168), (129, 132) - will extend epitope to encompass both, usually.

Example 27

Ii-Key/Hepatitis C MHC Class Ii Antigenic Epitope Hybrids

Experiments with human PBMC of hepatitis C virus (HCV)-infected persons will deteterming which Ii-Key/HCV MHC class II epitope hybrid can be used for protection of therapeutic vaccines in humans. Chronic HCV infection is the leading cause of liver cirrhosis and hepatocellular carcinoma worldwide. HCV infection results in high level virus production in the majority of cases. Spontaneous control of viremia occurs in 20-50% of patients. Spontaneous control of HCV viremia is associated with induction of robust and broadly directed HCV-specific CD4 T cell response. Vaccination strategies designed to enhance CD4 responses in infected individuals may result if increased immunological control of viremia. A frequently recognized viral MHC class II epitope that is highly conserved among HCV isolates to synthesize a set of Ii-key hybrid peptides to determine if the hybrid peptides result in greater CD4 T cell responses from HCV infected individuals was selected. The addition of an Ii-Key box at the N-terminus before an HCV-epitope enhances the potency of this epitope to stimulate HCV-specific CD4 responses, with improved ability (i) to induce direct effector functions in terms of cytokine secretion, (ii) to induce epitope-specific CD4$^+$ T cell proliferation in the absence of costimulus or adjuvant cytokine, (iii) to provide CD4 cell help for CD8$^+$ T cell proliferation, and (iv) to generate HIV-specific CD4 cell lines using standard procedures.

TABLE 27.1

Ii-Key/MHC class II epitope of HCV NS3.

| Peptide # | AE# | N-term | SEQ | C-term | SEQ ID NO |
|---|---|---|---|---|---|
| 27.1.1 | AE-P61 | Ac-LRMK-ava- | GYKVLVLNPSVAAT | $-NH_2$ | 1009 |
| 27.1.2 | AE-P62 | Ac-LRMK-ava- | YKVLVLNPSVAAT | $-NH_2$ | 1010 |
| 27.1.3 | AE-P63 | Ac-LRMK-ava- | KVLVLNPSVAAT | $-NH_2$ | 1011 |
| 27.1.4 | AE-P64 | Ac-LRMK-ava- | VLVLNPSVAAT | $-NH_2$ | 1012 |
| 27.1.5 | AE-P65 | Ac-LRMK-ava- | LVLNPSVAAT | $-NH_2$ | 1013 |
| 27.1.6 | AE-P66 | Ac-LRMK-ava- | VLVLDPSVAAT | $-NH_2$ | 1014 |
| 27.1.7 | AE-P67 | Ac— | GYKVLVLNPSVAAT | $-NH_2$ | 1015 |
| 27.1.8 | AE-P68 | Ac— | VLVLNPSVAAT | $-NH_2$ | 1016 |
| 27.1.9 | AE-P69 | Ac— | VLVLDPSVAAT | $-NH_2$ | 1017 |
| 27.1.10 | | | PAAYAAQGYKVLVLNPSVAA | | 118 |
| 27.1.11 | | | AQGYKVLVLNPSVAA | | 1019 |
| 27.1.12 | AE-P70 | Ac-LRMK-ava- | VLNPSVAAT | $-NH_2$ | 1020 |
| 27.1.13 | AE-P71 | Ac-LRMK-ava- | LNPSVAAT | $-NH_2$ | 1021 |
| 27.1.14 | AE-P72 | Ac-LRMK-ava- | NPSVAAT | $-NH_2$ | 1022 |

-ava- = delta aminovaleric acid = 5-aminopentanoic acid

TABLE 27.2

Ii-Key/MHC class II epitope hybrids of HCV NS3(1248-1261).

| Peptide# | AE# | EPI SEQ N-term | SEQ | C-term | SEQ ID NO |
|---|---|---|---|---|---|
| 27.2.1 | AE-K1 | | GYKVLVLNPSVAATL | | 1023 |
| 27.2.2 | AE-P61 | Ac-LRLK-ava- | GYKVLVLNPSVAAT | $-NH_2$ | 1024 |
| 27.2.3 | AE-P62 | Ac-LRLK-ava- | YKVLVLNPSVAAT | $-NH_2$ | 1025 |
| 27.2.4 | AE-P63 | Ac-LRLK-ava- | KVLVLNPSVAAT | $-NH_2$ | 1026 |
| 27.2.5 | AE-P64 | Ac-LRLK-ava- | VLVLNPSVAAT | $-NH_2$ | 1027 |
| 27.2.6 | AE-P65 | Ac-LRLK-ava- | LVLNPSVAAT | $-NH_2$ | 1028 |
| 27.2.7 | AE-P66 | Ac— | GYKVLVLNPSVAAT | $-NH_2$ | 1029 |
| 27.2.8 | AE-P67 | Ac— | VLVLNPSVAAT | $-NH_2$ | 1030 |

-ava- = delta aminovaleric acid = 5-aminopentanoic acid;
X = methionine sulfone

Studies similar to those described above will be pursued with HCV MHC class II epitopes synthesized as Ii-key hybrid peptides. CD4 and CD8 lymphocytes control HCMV infection in immunocompetent individuals. Individuals undergoing hemopoietic stem cell transplantation (HSC) are immunocompromised and HCMV infection is a frequent opportunistic infection. Administration of CMV-specific CD8 lymphocytes has been demonstrated to be beneficial for (HSC) graft recipients. Since CD4 cells contribute to expansion of cytotoxic T lymphocytes (CTL), T(h) peptides on the immunodominant protein pp 65 recognized by CD4 cells may be useful in complementing CTL administration with CMV-specific T(h) cells. In addition, vaccination strategies designed to enhance CD4 responses in infected individuals may result if increased immunologic control of viremia.

Example 28

Ii-Key/Vaccinia B5R p42 MHC Class Ii Antigenic Epitope Hybrids

Ii-Key/smallpox antigenic epitope vaccines offer robust and relatively safe protection against smallpox, when used either alone or in combination with other vaccination methods. The potency and safety of certain other vaccines such as vaccinia virus are enhanced substantially, when preceded by one or more immunizations with an Ii-Key/smallpox antigenic epitope vaccine. Protection of a large population can be achieved with solely the use of the Ii-Key/smallpox antigenic epitope hybrid vaccine or preferably with such a vaccine in which the MHC Class II epitope is joined or overlapped in sequence with a MHC Class I-presented (cytotoxic T lymphocyte inducing) epitope and/or an antibody-recognized (virus neutralizing) epitope. Immunization with Ii-Key/smallpox antigenic epitope vaccines also improves clinical outlook for individuals infected with smallpox virus without prior vaccinia immunizations. The Ii-Key/antigenic epitope hybrid vaccines will enhance the protective responses of persons receiving a preventative vaccine with either vaccinia virus or a DNA for a smallpox or vaccinia viral protein. The efficacy of vaccinia virus vaccines given to individuals immediately upon exposure or potentially exposure to smallpox ("ring vaccination"), will be accelerated in terms of the speed and potency of the protective response. The biology and clinical course of smallpox infections is reviewed in order to understand the substantial benefits brought to the prevention of smallpox by the products and methods of this Disclosure.

Variola major, the smallpox virus, belongs to the family Poxyiridae, subfamily Chordopoxyirinae, and genus *orthopoxvirus*, which includes vaccinia (the smallpox vaccine), monkey poxvirus, and several others animal poxviruses that cross-react serologically (Breman J G. N Engl J Med. 2002 346:1300-8; Moss B. in Fields B N. Fields Virology. 1996: 2637-71; Fenner F. in Fields B N. Virology. 1996: 2673-83). The poxviruses are among the largest viruses known, containing one linear, double-stranded DNA molecule of 130 to 375 kb and replicating inn the cytoplasm.

There are five patterns of smallpox infections. Variola major (ordinary smallpox) was responsible for 90% of cases in the pre-eradication era and is associated with an overall case-fatality rate of 30% (15% to 45%) in unvaccinated patients. Flat-type or malignant smallpox and hemorrhagic smallpox typically occur in patients with a defective immune system, and case fatality rates are 97% and 96% respectively. Smallpox in children is generally similar to smallpox in adults except the case fatality rate in infants is over 40%. Variola minor is the mildest form that predominated in outbreaks in the U.S. and Great Britain, with case fatality rates <1% (Fenner F. Bull WHO. 1988 1-68, 121-208; Henderson D A. JAMA. 1999 281:2127-39).

The smallpox virus enters through the respiratory tract, passing rapidly to lymph nodes to multiply in the reticuloendothelial system over 14 days. Mucous membranes in the oropharynx become infected, as well as the capillary epithelium of the dermis leading to skin lesions. Oropharyngx and skin lesions contain abundant viral particles; virus is also present in the urine and conjunctival secretions. Cytotoxic T-cells and B-cells arise to limit the infection; neutralizing antibodies appear in the first week of infection but are delayed if infection is severe (Fenner F. in Fields B N. Virology. 1996: 2673-831996; Roberts J A. Br J Exp Pathol. 1962 43:451-61; Bedson H S. J Pathol Bacteriol. 1963 85:1-20; Buller R M. Microbiol Rev. 1991 55:80-122; Zaucha G M. Lab Invest. 2001 81:1581-600; Sarkar J K. Bull World Health Organ. 1973 48:517-22). The incubation period is 7 to 17 days (mean 10 to 12). The prodromal phase, which lasts for two to three days, is characterized by severe headache, backache, and fever, all beginning abruptly (Dixon C W. Smallpox. London, 1962). Enanthema of the tongue, mouth, and oropharynx precede the rash by a day. The rash begins as small, reddish macules, which become papules with a diameter of 2 to 3 mm. The papules become vesicles with a diameter of 2 to 5 mm. Pustules of 4 to 6 mm diameter develop four to seven days after the rash. Smallpox lesions with a peripheral distribution, generally are all at the same stage of development (in contrast to chicken pox lesions). Lesions on the palms and soles persist the longest. Death from smallpox is ascribed to toxemia, associated with immune complexes, and hypotension secondary to fluid and protein loss.

Variola is transmitted predominantly from person to person by droplet inhalation, most commonly among those with close face-to-face contact (Fenner F. Bull WHO. 1988 1-68, 121-208). Airborne and fomite (laundry, bedding) transmission occurs (Dixon C W. Smallpox. London, 1962). Patients are infectious from the time of fever onset, immediately prior to rash development. Secondary attack rates range from 37% to >70% (Rao A R. Indian J Med Res. 1968 56:1826-54; Arnt N. Am J Epidemiol. 1972 94:363-70; Heiner G G. Am J Epidemiol. 1971 94:316-26), with a primary case infecting 3.6 to 6 others (Gani R. Nature. 2001 414:748-51). In the 1970s outbreaks in Yugoslavia and Germany, there were 11 to 38 infected contacts per index case (Fenner F. Bull WHO. 1988 1-68, 121-208). Thus in populations with low herd immunity, transmission rapidly creates outbreak cases before control measures take hold. Infectivity lasts until all lesions have scabbed over and the scabs have fallen off.

Patients with smallpox are treated supportively—adequate fluid intake (which is difficult due to oropharyngeal enanthema), alleviation of pain and fever, keeping skin lesions clean to prevent bacterial superinfection. Although no antivirals are approved for smallpox by the U.S. FDA, many compounds have been screened for therapeutic activity. Cidofivir (Vistide®, approved for CMV retinitis) shows activity against *orthopoxviruses*, including variola (CIDRAP/IDSA. 2002).

Smallpox vaccination began in China in 1000 AD with "variolation", administration of infectious material from an infected patient to uninfected individuals. Edward Jenner discovered in the late 1700s that cowpox protected against smallpox. Vaccinia virus, genetically distinct from cowpox, has replaced cowpox as a vaccine (CIDRAP/IDSA. 2002). Protection is afforded for 5-10 years after primary vaccination; neutralizing antibodies are detected up to 10 years in 75% of individuals receiving 2 doses of vaccine, and up to 30 years in those vaccinated with 3 doses (Henderson D A. JAMA. 1999:281:2127-39). After an intensive worldwide campaign initiated in earnest in 1967, smallpox eradication was declared in 1980. With no natural reservoirs, variola has since existed only in laboratories. The WHO has sanctioned two depositories—The Center for Disease Control and Prevention (Atlanta, Ga.) and the State Research Center of Virology and Biotechnology (the Vektor Institute) in Novosibirsk, Russia. Inappropriately available variola virus could be a weapon of terrorists. Since less than 20% of 157 million individuals vaccinated before the early 1970s (when routine vaccination was discontinued in the US) are protected today and 119 million Americans have never been vaccinated, the need and problems of vaccinating against smallpox are being considered most carefully.

The Working Group on Civilian Biodefense has identified a number of widely known organisms that could cause disease and deaths in sufficient numbers to cripple a city or region. Smallpox used as a biological weapon, is perhaps the most serious threat to civilian populations due to its ease of transmission, case-fatality rate of 30% or more among unvaccinated persons, and the absence of a specific therapy. Although smallpox has long been feared as the most terrible of all infectious diseases, its potential for devastation today is much greater than at any previous time. Routine vaccination throughout the US ceased 25 years ago. In a now highly susceptible, mobile population, smallpox would spread widely and rapidly throughout this country and the world (Henderson D A JAMA. 1999 281:2127-39; Fenner F. Bull WHO. 1988 1-68, 121-208).

The U.S. vaccinia vaccine since the 1970s, Dryvax, is a lyophilized live vaccinia virus preparation manufactured by Wyeth. The vaccine is administered on a bifurcated needle containing a droplet of the reconstituted product; the skin of the upper arm is poked approximately 15 times creating a wound producing a drop of blood. To elicit a protective response, a "Jennerian pustule" must be induced. In an effort to expand current supplies in light of bioterrorism threats, recent clinical trials have tested the protective effects of Dryvax at dilutions of 1:1, 1:5, 1:10, and 1:100 (Frey S E. N Engl J Med. 2002 346:1265-75; Frey S E. N Engl J Med. 2002 346:1275-80). A major response was observed in 95% with undiluted product, 70% with 1:10 diluted vaccine, and 15% with 1:100 diluted vaccine. One month after vaccination, 34 of the 36 subjects with major reactions developed antibody responses compared to 1 of 24 patients who did not develop Jennerian pustules (Frey S E. N Engl J Med. 2002 346:1275-80). Vigorous cytotoxic T-cell and IFN-ã responses occurred in 94% of subjects with major reactions and only 1 of 24 patients who did not develop Jennerian pustules.

Routine vaccination was discontinued in 1979 because the risk of complications from the vaccine outweighed the threat of endemic smallpox (Fenner F. Bull WHO. 1988 1-68, 121-208). A 10 state study indicated that there were 1254 complications per 1 million primary vaccinations including encephalitis, progressive vaccinia, eczema vaccinatum, generalized vaccinia, and erythema multiforme (Lane J M. J Infect Dis. 1970 122:303-9). A nationwide survey showed that the case fatality rate was 1 per 1 million primary vaccinations (Lane J M. N Engl J Med. 1969 281:1201-8). Certain groups of individuals are contraindicated to be vaccinated—those with conditions causing immunodeficiency (i.e., HIV infection, leukemia, lymphoma, generalized malignancy, agammaglobulinemia, organ transplant recipients, or therapy with alkylating agents, antimetabolites, radiation, or large doses of corticosteroids), persons with eczema, persons with household contacts who are immunodeficient or who have a history of eczema, and pregnant women.

Based on the observed morbidity and mortality associated with vaccinia vaccination in the US from 1967 to 1979, a mass smallpox preventative vaccination campaign in the U.S. general public aged 1 to 65 could result in as many as 4,600 serious adverse events and 285 deaths (excluding high-risk persons and their immediate contacts) (Kemper A R. Eff Clin Pract. 2002 5:84-6). Indeed, dictating that everyone receives the Dryvax vaccine would sentence as many as 400 people to death and many others to seriously debilitating side effects (Grand Rapids Press Apr. 10, 2002). Therefore, the CDC has recommended a "ring vaccination" or containment strategy. In this approach, the following individuals receive the vaccine following actual or potential release of variola virus: persons directly exposed to the release; persons with face-to-face or household contact with an infected patient or in close proximity (within 2 m); personnel directly involved in the evaluation, care, or transport of infected patients; laboratory personnel involved in processing specimens; and others likely to have contact with infectious materials (CDC Interim Smallpox Response Plan CDC November 2001; Vaccinia ACIP Morb Mortal Wkly Rep. 2001 50:1-25).

Compared to mass vaccination, ring vaccination is clearly not optimal the following reasons. (1) Pre-emptive voluntary vaccination eliminates the value of smallpox as a weapon, serving as an effective deterrent. (2) Ring vaccination is effective only for the eradication of small, localized outbreaks in a population with widespread immunity. In a largely non-immune mobile population, epidemic control after multiple simultaneous exposures is a vastly different challenge. (3) Ring vaccination requires prompt identification and vaccination of infected individuals within the 3-day post exposure period when the vaccination might be effective. A person might be infective for several days before smallpox is clinically obvious, therefore, identification of cases of exposure to an infected terrorist, for example, within a four-day period is logistically impossible. (4) The CDC is assuming that each infected person will infect only 2 to 3 others, however, as many as 38 secondary infections have been observed. (5) The logistical complexity of administering millions of vaccine doses in an acute emergency is daunting and likely to induce panic and collapse of the medical and public health service as was observed in the Dark Winter simulation exercise conducted by Johns Hopkins University in June 2001 (Bicknell W J. N Engl J Med. 2002 346: 1323-25; Henderson D A. JAMA. 1999 281:2127-39; Millar J D. Public Health Policy Advisory Board. 2000; Fenner F. Bull WHO. 1988:1-68, 121-208; O'Toole T. Johns Hopkins Center for Civilian Biodefense Strategies. 2001). In contrast, pre-exposure vaccination does not pose the logistical difficulties of vaccination during an outbreak and is less expensive. In addition, pre-exposure vaccination reduces the risk of infection among immunocompromised persons (Rosenthal S R. Emerg Infect Dis. 2001 7:920-6).

Improved vaccines capable of safely and rapidly eliciting long-lasting immunity against smallpox in all persons are clearly needed. Whether used in mass or ring vaccination strategies, greater safety and efficacy relative to Dryvax is required. The Ii-Key/antigenic epitope hybrid used alone or in combination with DNA vaccines will have the following preferred characteristics relative to Dryvax: (1) significantly reduced complication rate including death and debilitating side effects, (2) more rapid induction of protective antibodies and viral-specific cytotoxic T-cells (3) simpler vaccination method, (4) greater period of protection following primary vaccination, and (5) broader target population including use in immunocompromised individuals and in pregnancy.

One preferred approach to protecting large populations is administration of one or more immunizations with an Ii-Key/smallpox antigenic epitope hybrid of this Disclosure, followed according to the ring immunization concept by vaccinia or similar viral vaccines in the population subset of exposed or potentially exposed individuals. However, in addition, when individuals who were not in the immunized ring, contract smallpox, significant protection is afforded by prior expansion and memory of $CD4^+$ T helper cell clones, $CD8^+$ cytotoxic T lymphocyte clones, and B cell immunoglobulin producing clones as the case might be. Such responses create a more rapid time frame for development of clinically protective responses frame to presentation of those same and other epitopes by the smallpox virus, than would be the case in individuals not immunized with the hybrids. The process of inducing responses to viral epitopes other than that in the immunizing Ii-Key/smallpox antigenic epitope hybrid, is referred to as epitope spreading.

Although vaccination is generally regarded to be the best defense against smallpox virus, the approved vaccines and some in development are not optimally safe or potent. The Ii-Key/smallpox MHC Class II epitope hybrid vaccines can be used either alone or together with other approaches, including whole virus preparations, DNA and RNA vaccines, inactivated whole virus, and virus-like particles. The Ii-Key/antigenic epitope hybrid vaccines revealed in this Disclosure can be used in conjunction with diluted whole virus preparations, e.g., Dryvax, in order to improve the major reaction rate typically observed with diluted preparations and allow for decreased rates of complications (Frey S E. N Engl J Med 2002 346:1265-75; Frey S E. N Engl J Med 2002 346:1275-80). In addition, Ii-Key/smallpox MHC Class II epitope hybrid vaccines can be used with attenuated virus strains that have been developed (Ankara MVA and Japanese strain LC16 m8) in order to augment their efficacy (Rosenthal S R. Emerg Infect Dis 2001 7:920-6; Henderson D A JAMA. 1999:281:2127-39). Ii-Key/smallpox MHC Class II epitope hybrid vaccines can be used with DNA or RNA vaccines targeting gene products that are critical for viral pathogenicity and infectivity, for example, B5R and others (Phillpotts R J. Acta Virol 2000 44:151-6; Mathew E C. J Gen Virol 2001 82:1199-213).

Ii-Key/smallpox antigenic epitope hybrids offer potent and safe vaccines against smallpox. One favored example uses Ii-Key/antigenic epitope hybrids containing the Ii-Key LRMK motif and an MHC Class II epitope of the smallpox B5R gene product gp42. Such a construct can be further enhanced with a linked or overlapping MHC Class I epitope(s) and/or antibody-determined epitope(s). By boosting the Th response >200 times to the MHC Class II epitope, Th1 cells are recruited to elicit potent CTL and humoral responses with immunological memory. Addition of a MHC Class I epitope to the hybrid affords antigenic epitope-specific enhancement of the cytotoxic T lymphocyte response. Addition of an antibody-recognized epitope to the hybrid affords antigenic epitope-specific enhancement of the antibody-determined response.

Smallpox gp42 is selected for several reasons. (1) Gene B5R encodes a 42 kD glycoprotein that is expressed throughout the course of infection and forms part of the envelope of the extracellular virus. (2) gp42 is required for the envelopment and egress of extracellular virus and virus virulence. (3) gp42-specific IgG neutralizing antibodies are correlated with protection against *orthopox* infection in humans (Phillpotts R J. Acta Virol 2000 44:151-6; Englestad M. Virology. 194:627-37; Mathew E C. J Gen Virol 2001 82:1199-213). In the course of routine experimentation to identify the biologically function and vaccine potential of additional proteins coded for or induced by the smallpox virus, additional candidates for the design, synthesis and use of Ii-Key/smallpox antigenic epitope hybrids will be targeted. The methods of this Disclosure can be applied without undue experimentation toward the development of additional Ii-Key/smallpox antigenic epitope hybrid vaccines. Other extracellular envelope proteins such as A33R, A34R, A36R, and A56R, can be used to produce Ii-Key/antigenic epitope hybrids.

In addition to the above vaccine methods, the Ii-Key/smallpox antigenic epitope hybrids can be used to enhance responses to DNA vaccines encoding B5R gp42. Such DNA vaccines can also be enhanced further by incorporating the Ii reverse gene construct in the same plasmid or delivery construct. Suppression of Ii protein expression allows for the presentation of endogenous gp42 epitopes. In the context of B5R DNA vaccination, targeted Ii-suppressed antigen presenting cells will present an increased repertoire of novel, perhaps cryptic, B5R epitopes.

This invention relates in part to the design of Ii-Key/Variola B5R protein antigenic epitope hybrids. The genes of the variola virus have been identified and sequenced principally by investigators in Russia (Shchelkunov S N. FEBS Lett. 1993 319:80-83: Shchelkunov S N. Virus Res. 1994 34:207-236; Shchelkunov S N. Virus Genes 1995: 9:231-245; Shchelkunov S N. Virus Res. 1996 40:169-183).

Specific Aim 2. To perform comparable studies with vaccinia B5R epitopes.

Studies similar to those described above will be pursued with HIV MHC class II epitopes synthesized as Ii-key hybrid peptides. CD4+ and CD8+ T lymphocytes control vaccinia infection in immunocompetent individuals. By expanding CD4+ T cell activation, potent and safe peptide-based Pre-Vaccines™ against smallpox will be developed. Dangers of the currently available Dryvax™ vaccinia vaccine (death, neurological damage, generalized spread with potential for bacterial superinfection, etc.) force compromises from ideal vaccination plans. Only potentially exposed, front-line personnel will be vaccinated, otherwise the plan is "ring vaccination" (vaccinating contacts and potential contacts after an outbreak or suspected outbreak). Priming individuals against MHC Class II-presented antigenic epitopes of vaccinia gp42, prior to vaccinating with vaccinia or with B5R DNA, offers significant advantages, particularly during the anticipated public health crises that are expected in the wake of a bioterrorism attack including: 1) safety of the peptide-based Pre-Vaccine™, 2) potentially increased safety of subsequently administered vaccinia vaccine, 3) more rapid, potent, and complete (% of population) responses to vaccinia, 4) some protection against variola for infected individuals who missed the ring vaccination, 5) increased window within which to initiate ring vaccination strategy following primary exposure, 6) decreased dose of vaccinia during ring vaccination, and 7) protection for individuals (e.g., immunocompromised) who are contraindicated from receiving vaccinia virus, either directly or via secondary exposure from immunized individuals. Some frequently recognized viral MHC class II epitopes derived from the vaccinia B5R protein to synthesize sets of Ii-key hybrid peptides to determine if the hybrid peptides result in greater CD4 T cell responses in patients that will receive the vaccinia vaccine were selected.

In the proposed study, CD4+ T cell responses to MHC class II epitopes derived from the vaccinia B5R protein and Ii-key hybrid peptides will be determined in individuals recently vaccinated with the currently available vaccinia Dryvax™

In addition, studies similar to those above can be performed to identify and characterize lymphocytic choriomenengitis virus (LCMV) epitopes. LCMV MHC class II epitopes synthesized as Ii-key hybrid peptides. CD4+ and CD8+ T lymphocytes control LCMV infection in mice. By expanding CD4+ T cell activation, potent and safe peptide-based Ii-Key/MHC class II epitope hybrid peptide vaccines will be developed.

TABLE 28.1

Ii-Key/MHC class II epitope hybrids of vaccinia B5R.

| AET | N-term | Spacer | f-N | Epitope | f-C | C-term | SEQ ID NO |
|---|---|---|---|---|---|---|---|
| 158 | Ac— | LRMK-ava | NC | DVGYEVIGA | SY | —NH$_2$ | 1031 |
| 20 | Ac— | LRMK-ava | YS | TCTVPTMNN | AK | —NH$_2$ | 1032 |
| 173 | Ac— | LRMK-ava | CT | ANSWNVIPS | CQ | —NH$_2$ | 1033 |
| 41 | Ac— | LRMK-ava | ND | KQKVTFTCD | QG | —NH$_2$ | 1034 |
| 149 | Ac— | LRMK-ava | YS | FGEYITINC | DV | —NH$_2$ | 1035 |
| 146 | Ac— | LRMK-ava | KE | KYSFGEYIT | IN | —NH$_2$ | 1036 |
| 49 | Ac— | LRMK-ava | TC | DQGYHSLDP | NA | —NH$_2$ | 1037 |

TABLE 28.1-continued

Ii-Key/MHC class II epitope hybrids of vaccinia B5R.

| AET | N-term | Spacer | f-N | Epitope | f-C | C-term | SEQ ID NO |
|---|---|---|---|---|---|---|---|
| 57 | Ac— | LRMK-ava | LD | PNAVCETDK | WK | —NH$_2$ | 1038 |
| 87 | Ac— | LRMK-ava | LY | DKPLYEVNS | TM | —NH$_2$ | 1039 |
| 88 | Ac— | LRMK-ava | YD | KPLYEVNST | MT | —NH$_2$ | 1040 |
| 254 | Ac— | LRMK-ava | DD | ETDLSKLSK | DV | —NH$_2$ | 1041 |
| 14 | Ac— | LRMK-ava | VL | PAVVYSTCT | VP | —NH$_2$ | 1042 |
| 227 | Ac— | LRMK-ava | CI | DGKWNPILP | TC | —NH$_2$ | 1043 |
| 96 | Ac— | LRMK-ava | NS | TMTLSCNGE | TK | —NH$_2$ | 1044 |
| 185 | Ac— | LRMK-ava | QQ | KCDMPSLSN | GL | —NH$_2$ | 1045 |
| 116 | Ac— | LRMK-ava | NG | NTSWNDTVT | CP | —NH$_2$ | 1046 |
| 46 | Ac— | LRMK-ava | VT | FTCDQGYHS | LD | —NH$_2$ | 1047 |
| 212 | Ac— | LRMK-ava | SC | KSGFILTGS | PS | —NH$_2$ | 1048 |
| 75 | Ac— | LRMK-ava | KK | MCTVSDYVS | EL | —NH$_2$ | 1049 |
| 246 | Ac— | LRMK-ava | FD | PVDDGPDDE | TD | —NH$_2$ | 1050 |
| 43 | Ac— | LRMK-ava | KQ | KVTFTCDQG | YH | —NH$_2$ | 1051 |
| 223 | Ac— | LRMK-ava | PS | STCIDGKWN | PI | —NH$_2$ | 1052 |
| 28 | Ac— | LRMK-ava | MN | NAKLTSTET | SF | —NH$_2$ | 1053 |
| 35 | Ac— | LRMK-ava | ST | ETSFNDKQK | VT | —NH$_2$ | 1054 |

-ava- = delta aminovaleric acid = 5-aminopentanoic acid

AET = peptide identifying number (e.g., AET-158).

N-term. = blocking acetylation.

f-N = N-terminal flanking two amino acids.

Spacer = LRMK (SEQ ID NO.: 3) followed by one 5-aminopentanoic acid residue.

Epitope = predicted epitope.

f-C = C-terminal flanking two amino acids.

Example 29

Ii-Key/SARS MHC Class II Epitope Hybrids

Prediction of Epitopes.

SARS coronavirus encodes two replicases, a spike protein, and a N protein and other proteins (genbank AY278488, AY278554, AY274119, AY278741). The 30 k virus genomes of different sources are highly homologous, indicating SARS coronavirus to be relatively stable. The "Beijing" coronavirus sequence AY278488 is taken as a prototypic model. One putative replicase (ORF-1), spike protein, and N protein have a high frequency of high-scoring HLA-DR-restricted epitopes upon examination with the Raghava program (access at: www.imtech.res.in/raghava/propred/). 40 SARS epitopes were identified and corresponding Ii-Key hybrids were synthesized. In order to test the possibility that more HLA-DR-restricted SARS epitopes are present in both S and N proteins, overlapping peptides (32 amino acids) were also synthesized for testing, according to the following principles.

High score. Peptides with the highest score from the Raghava analysis were used due to a better likelihood for experimental immunogenecity in individuals with the scored-for HLA-DR allele. For example, epitope #1(650) is restricted by HLA-DRB1*0701. For any epitopes restricted by this allele, the highest score is 11.6; epitope #1 with a score 9.5 is, thus, among the top 81.9% of the range of predicted epitopes (Table 29.1).

HLA-DR coverage. Epitopes, which were predicted to be presented by two or more HLA-DR alleles, were chosen for broader HLA-DR coverage. The ultimate goal is to identify the fewest number of epitopes that will immunize the largest fraction of humans. Often, an epitope with a medium prediction score is more likely to be restricted by more than one HLA-DR allele. However, several epitopes (for example; 1780, 2497, 2930, and 3665) were formed to be restricted by three or four HLA-DR alleles and yet have relatively high prediction scores. Epitope #21 was chosen from spike protein and epitope #38 from N protein were restricted by all tested HLA-DR alleles (Table 29.3). These epitopes are likely to be immunogenic, and yet to react more frequently with PBMCs from people with different HLA-DR alleles.

Prediction of co-presentation by murine MHC class II alleles. Some HLA-DR-presented epitopes that were also predicted to be restricted by murine H-2E$^K$ were also selected to make possible parallel mice experiments to assess in vivo activity of such epitopes and for additional preclinical assays such as toxicology. For use in clinical trials, it will be necessary to test for such in vivo activity of the epitopes that are active in PBMC in vitro stimulation. When possible, it is always preferred also to evaluate biological activity and toxicology in mice, of those epitopes that are active in human PBMC assays. Several computer-predicted HLA-DR epitopes, which are also predicted to be active in both humans and mice (Table 29.3).

TABLE 29.1

Partial list of HLA-DR-restricted epitopes
(SEQ ID NOS: 1055-1093, respectively, in order of appearance;
1st amino acid is in p1 site of antigenic peptide-binding trough).

| Peptide#¶ | At Position | Epitope | HLA-DR-restrictions (DRB1) |
|---|---|---|---|
| 29.1.1 | 650* | FLITGVFDI | 0701, H-2E$^k$ |
| 29.1.3 | 1032 | MVIVNAANI | 0101, 0301, 0701, 1501 |
| 29.1.4 | 1711 | LLQHANLES | 0401, 1501 |
| 29.1.5 | 1780 | FVMMSAPPA | 0101, 0301, 0401, 0801, 1101 |
| 29.1.6 | 2147* | YVFTLLFQL | 0401, 0701, H-2E$^k$ |
| 29.1.7 | 2208 | WLLLLSICL | 0101, 0701, 1501 |
| 29.1.8 | 2290 | YKLDLTILG | 0301, 0401, H-2E$^k$ |
| 29.1.9 | 2357 | VRMYIFFAS | 0301, 1101, 1501 |
| 29.1.10 | 2497* | FVNLDNLRA | 0101, 0401, 1501, H-2E$^k$ |
| 29.1.11 | 2748 | LMLKATLLC | 0801, 1101 |
| 29.1.12 | 2930 | YVLMDGSII | 0101, 0301, 0401, 0701, 1501 |
| 29.1.13 | 3061* | FLMSFTILC | 0701, 1501, H-2E$^k$ |
| 29.1.14 | 3120 | YVFCISLKH | 0401, 0701, H-2Ek |
| 29.1.15 | 3136 | YLRKRVMFN | 0801 |
| 29.1.16 | 3637* | MRIMTWLEL | 0701, 1501 |
| 29.1.17 | 3665* | LVLLILMTA | 0301, 0401, 1101, 1501, H-2E$^k$ |
| 29.1.18 | 3796 | FRYMNSQGL | 0101, 0401, 0701 |
| 29.1.19 | 3846* | VVLLSVLQQ | 0701, 0801, 1101, H-2E$^k$ |
| 29.1.20 | 3887* | MVSLLSVLL | 0101, 0701, 1101, 1501 |
| 29.1.21 | 1* | FIFLLFLTL | 0101, 0401, 0701, 0801, 1101, 1301, 1501, H- |
| 29.1.22 | 45* | IFRSDTLYL | 0301, 0401, 0701 |
| 29.1.23 | 116 | INNSTNVVI | 0101, 0301, 0401, 0701, 1501 |
| 29.1.24 | 122* | VVIRACNFE | 0301, 0801, 1301, 1501 |
| 29.1.25 | 196 | YKGYQPIDV | 0101, 0701, 0801, 1501 |
| 29.1.26 | 230 | FRAILTAFS | 0101, 0401, 0801, 1101, 1301 |
| 29.1.27 | 304* | FRVVPSGDV | 0101, 0701, 1501, H-2E$^k$ |
| 29.1.28 | 353 | VLYNSTFFS | 0301, 0401, 0701, 1301 |
| 29.1.29 | 388 | VKGDDVRQI | 0301, 0701, 1301, H-2E$^k$ |
| 29.1.30 | 439 | YRYLRHGKL | 0101, 0701, 0801, 1101, 1301, 1501 |
| 29.1.31 | 881* | MQMAYRFNG | 0101, 0301, 1301,1501 |
| 29.1.32 | 932* | VVNQNAQAL | 0101, 0301, 0701, 1301 |
| 29.1.33 | 999* | IRASANLAA | 0301, 0401, 0701, 1501, H-2E$^k$ |
| 29.1.34 | 1041 | VVFLHVTYV | 0101, 0301, 0401, 1101, 1301, 1501 |
| 29.1.35 | 1076* | FVFNGTSWF | 0101, 0301, 0401, 0701, 0801, 1301, 1501 |
| 29.1.36 | 1110 | VIGIINNTV | 0301, 0401, 0701, 1301, 1501, H-2E$^k$ |
| 29.1.37 | 1208* | IVMVTILLC | 0301, 0401, 0701, 0801, 1101, 1301, 1501, H- |
| 29.1.38 | 87* | YRRATRRVR | 0101, 0301, 0401, 0701, 0801, 1101, 1301, |

TABLE 29.1-continued

Partial list of HLA-DR-restricted epitopes
(SEQ ID NOS: 1055-1093, respectively, in order of appearance;
1st amino acid is in p1 site of antigenic peptide-binding trough).

| Peptide# | At Position | Epitope | HLA-DR-restrictions (DRB1) |
|---|---|---|---|
| 29.1.39 | 221* | LLLLDRLNQ | 0101, 0301, 0701, 0801, 1101, 1301, 1501, H- |
| 29.1.40 | 314* | FFGMSRIGM | 0701, 0801, 1101, 1301, 1501 |

Peptides 1-20 are from SARS coronavirus ORF1-b. Peptides 21-37 are from SARS coronavirus Spike protein. Peptides 38-40 are from SARS coronavirus N protein.
*The same epitope is also predicted by another computer prediction program (access at: syfpeithi.bmi-heidelberg.com/scripts/MHCServer.dll/home.html).

Design Ii-Key/MHC II (SARS) Hybrids.

Since insertion of a MHC class II epitope into an Ii-Key hybrid has a higher potency of stimulation of T cells, Ii-Key/MHC II (SARS) hybrids are used to increase the possibility of finding biologically active epitopes (Table 29.2).

TABLE 29.2

Design Ii-Key/MHC class II hybrid vaccine peptides.

| Peptide# | Peptide# | N-term | Epitope | C-term | SEQ ID NO |
|---|---|---|---|---|---|
| 29.2.1 | SARS 41 | LRMK-ava- | ILKFLITGVFDIVK | –NH2 | 1094 |
| 29.2.2 | SARS 42 | LRMK-ava- | ANPMVIVNAANIHL | –NH2 | 1095 |
| 29.2.3 | SARS 43 | LRMK-ava- | MTHLLQHANLESAK | –NH2 | 1096 |
| 29.2.4 | SARS 44 | LRMK-ava- | ESSFVMMSAPPAEY | –NH2 | 1097 |
| 29.2.5 | SARS 45 | LRMK-ava- | YMPYVFTLLFQLCT | –NH2 | 1098 |
| 29.2.6 | SARS 46 | LRMK-ava- | IAMWLLLLSICLGS | –NH2 | 1099 |
| 29.2.7 | SARS 47 | LRMK-ava- | ISSYKLDLTILGLA | –NH2 | 1100 |
| 29.2.8 | SARS 48 | LRMK-ava- | SAMVRMYIFFASFY | –NH2 | 1101 |
| 29.2.9 | SARS 49 | LRMK-ava- | LSHFVNLDNLRANN | –NH2 | 1102 |
| 29.2.10 | SARS 50 | LRMK-ava- | CFKLMLKATLLCVL | –NH2 | 1103 |
| 29.2.11 | SARS 51 | LRMK-ava- | DTRYVLMDGSIIQF | –NH2 | 1104 |
| 29.2.12 | SARS 52 | LRMK-ava- | ALLFLMSFTILCLV | –NH2 | 1105 |
| 29.2.53 | SARS 53 | LRMK-ava- | TAIYVFCISLKHCH | –NH2 | 1106 |
| 29.2.14 | SARS 54 | LRMK-ava- | FNNYLRKRVMFNGV | –NH2 | 1107 |
| 29.2.15 | SARS 55 | LRMK-ava- | SWVMRIMTWLELAD | –NH2 | 1108 |
| 29.2.16 | SARS 56 | LRMK-ava- | ASALVLLILMTART | –NH2 | 1109 |
| 29.2.17 | SARS 57 | LRMK-ava- | FCLLNRYFRLTLGV | –NH2 | 1110 |
| 29.2.18 | SARS 58 | LRMK-ava- | TQEFRYMNSQGLLP | –NH2 | 1111 |
| 29.2.19 | SARS 59 | LRMK-ava- | CTSVVLLSVLQQLR | –NH2 | 1112 |
| 29.2.20 | SARS 60 | LRMK-ava- | FEKMVSLLSVLLSM | –NH2 | 1113 |
| 29.2.21 | SARS 61 | LRMK-ava- | MFIFLLFLTLTSGS | –NH2 | 1114 |
| 29.2.22 | SARS 62 | LRMK-ava- | PDEIFRSDTLYLTQ | –NH2 | 1115 |
| 29.2.23 | SARS 63 | LRMK-ava- | VIIINNSTNVVIRA | –NH2 | 1116 |
| 29.2.24 | SARS 64 | LRMK-ava- | STNVVIRACNFELC | –NH2 | 1117 |
| 29.2.25 | SARS 65 | LRMK-ava- | LYVYKGYQPIDVVR | –NH2 | 1118 |
| 29.2.26 | SARS 66 | LRMK-ava- | TNEFRAILTAFSPA | –NH2 | 1119 |
| 29.2.27 | SARS 67 | LRMK-ava- | TSNFRWPSGDVVR | –NH2 | 1120 |
| 29.2.28 | SARS 68 | LRMK-ava- | DYSVLYNSTFFSTF | –NH2 | 1121 |
| 29.2.29 | SARS 69 | LRMK-ava- | SFVVKGDDVRQIAP | –NH2 | 1122 |
| 29.2.30 | SARS 70 | LRMK-ava- | NYKYRYLRHGKLRP | –NH2 | 1123 |
| 29.2.31 | SARS 71 | LRMK-ava- | PFAMQMAYRFNGIG | –NH2 | 1124 |
| 29.2.32 | SARS 72 | LRMK-ava- | LQDVVNQNAQALNT | –NH2 | 1125 |
| 29.2.33 | SARS 73 | LRMK-ava- | AAEIRASANLAATK | –NH2 | 1126 |
| 29.2.34 | SARS 74 | LRMK-ava- | PHGVVFLHVTYVPS | –NH2 | 1127 |
| 29.2.35 | SARS 75 | LRMK-ava- | EGVFVFNGTSWFIT | –NH2 | 1128 |
| 29.2.36 | SARS 76 | LRMK-ava- | CDVVIGIINNTVYD | –NH2 | 1129 |
| 29.2.37 | SARS 77 | LRMK-ava- | LIAIVMVTILLCCM | –NH2 | 1130 |
| 29.2.38 | SARS 78 | LRMK-ava- | QIGYRRATRRVRGG | –NH2 | 1131 |
| 29.2.39 | SARS 79 | LRMK-ava- | ALALLLLDRLNQLE | –NH2 | 1132 |
| 29.2.40 | SARS 80 | LRMK-ava- | ASAFFGMSRIGMEV | –NH2 | 1133 |

The peptides from S and N proteins were also synthesized to identify additional MHC class II epitope (Table 29.3).

TABLE 29.3

32-mer overlapping peptides from regions with clustered HLA-DR predicted epitopes.

| Peptide No. | PEPTIDE Sequences | SEQ ID NO |
|---|---|---|
| 29.3.1 | YPDEIFRSDTLYLTQDLFLPFYSNVTGFHTIN | 1134 |
| 29.3.2 | PFKDGIYFAATEKSNVVRGWVFGSTMNNKSQS | 1135 |
| 29.3.3 | KSFEIDKGIYQTSNFRVVPSGDVVRFPNITNL | 1136 |
| 29.3.4 | VVRFPNITNLCPFGEVFNATKFPSVYAWERKK | 1137 |

TABLE 29.3-continued 32-mer overlapping peptides from regions with clustered HLA-DR predicted epitopes.

| Peptide No. | PEPTIDE Sequences | SEQ ID NO |
|---|---|---|
| 29.3.5 | AIHADQLTPAWRIYSTGNNVFQTQAGCLIGAE | 1138 |
| 29.3.6 | FSNVYADSFVVKGDDVRQIAPGQTGVIADYNY | 1139 |
| 29.3.7 | TGNYNYKYRYLRHGKLRPFERDISNVPFSPDG | 1140 |
| 29.3.8 | LSFELLNAPATVCGPKLSTDLIKNQCVNFNFN | 1141 |
| 29.3.9 | KNQCVNFNFNGLTGTGVLTPSSKRFQPFQQFG | 1142 |
| 29.3.10 | KRFQPFQQFGRDVSDFTDSVRDPKTSEILDIS | 1143 |
| 29.3.11 | PSVYAWERKKISNCVADYSVLYNSTFFSTFKC | 1144 |
| 29.3.12 | GAGICASYHTVSLLRSTSQKSIVAYTMSLGAD | 1145 |
| 29.3.13 | FCTQLNRALSGIAAEQDRNTREVFAQVKQMYK | 1146 |
| 29.3.14 | VFAQVKQMYKTPTLKYFGGFNFSQILPDPLKP | 1147 |
| 29.3.15 | GDINARDLICAQKFNGLTVLPPLLTDDMIAAY | 1148 |
| 29.3.16 | SQILPDPLKPTKRSFIEDLLFNKVTLADAGFM | 1149 |
| 29.3.17 | GAISSVLNDILSRLDKVEAEVQIDRLITGRLQ | 1150 |
| 29.3.18 | IDLQELGKYEQYIKWPWYVWLGFIAGLIAIVM | 1151 |
| 29.3.19 | SPRWYFYYLGTGPEASLPYGANKEGIVWVATE | 1152 |
| 29.3.20 | KEGIVWVATEGALNTPKDHIGTRNPNNNAATV | 1153 |

Example 30

Ii-Key/Influenza Virus HA MHC Class Ii Antigenic Epitope Hybrids

Summary.

Ii-Key/MHC class II flu H5 epitope hybrid peptide vaccines are the only near future, readily produced at a large scale, protection against an influenza H5N1 pandemic. Vaccination with a basket of 6-8 hybrids with H5 MHC class II epitopes presented by multiple DR alleles is feasible for protection of large numbers of people ($>10^8$) over a relatively brief period of time. The prototypic vaccine peptides, have been designed and synthesized for testing. Studies with analogs in other viral and cancer antigen systems, predict a substantial boosting of T helper cell responses by Ii-Key/influenza MHC class II epitope hybrids, with enhancement of subsequent protective responses occurring upon: a) infection with H5 flu, b) vaccination with an attenuated or inactivated H5 vaccine (possibly at lower doses), and c) vaccination with H5 recombinant protein (possibly at lower doses). A program is outlined to test these concepts for both H1 and H5 flu and to select baskets of H1 and of H5 Ii-Key/MHC II hybrids for clinical trials. An H1 trial points the way to the H5 vaccine and could become an augmenting vaccine by itself toward multiseasonal protection, since H1 MHC class II epitope variations during drift, are substantially less than seen with shift among influenza strains.

The first step of this program has revealed that upon shift in epidemic influenza stains, for example from H1 to H3 or from H1 to H5, there are negligible numbers of conserved MHC class II epitopes between HA proteins of such different types. This finding means little or no protection against H5 exists from T helper cell anamestic responses to H1 or H3 MHC class II epitopes. However, a basket of Ii-Key/H5 MHC class II epitope hybrids are the only route to generating anamestic T helper cell responses to H5 for large numbers of people, given the cost and difficulty of preparing rH5 protein or H5 DNA vaccines.

In contrast, the high frequency of MHC class II epitope homologies among strains arising from intra and inter-seasonal drift of one strain, makes feasible a multiseasonal booster vaccine comprising a basket of prominent MHC class II epitopes.

Practical aspects of acting on these conclusions are considered in both enhancing protection against prevalent and "drifted" H1 and H3 strains, and against a potential H5 strain pandemic.

H5 Influenza Infection.

Avian influenza A (H5N1) occurred in January 2004 with a high frequency of death in 10 patients in Vietnam (Tran T H N Engl J. Med. 2004 18; 350:1179-88). Outbreaks of avian influenza A (H5N1) in poultry throughout Asia have had major economic and health repercussions. Clinical features and preliminary epidemiologic findings were established among 10 patients with confirmed cases of avian influenza A (H5N1) who presented to hospitals in Ho Chi Minh City and Hanoi, Vietnam, in December 2003 and January 2004. In all 10 cases, the diagnosis of influenza A (H5N1) was confirmed by means of viral culture or reverse transcriptase-polymerase chain reaction with primers specific for H5 and N1. None of the 10 patients (mean age, 13.7 years) had preexisting medical conditions. Nine of them had a clear history of direct contact with poultry (median time before onset of illness, three days). All patients presented with fever (temperature, 38.5 to 40.0 degrees C.), respiratory symptoms, and clinically significant lymphopenia (median lymphocyte count, 700 per cubic millimeter). The median platelet count was 75,500 per cubic millimeter. Seven patients had diarrhea. In all patients, there were marked abnormalities on chest radiography. There was no definitive evidence of human-to-human transmission. Eight patients died. Although in all 10 cases the infection appears to have been acquired directly from infected poultry, the potential exists for genetic reassortment with human influenza viruses and the evolution of human-to-human transmission. Since influenza A (H5N1) infection, characterized by fever, respiratory symptoms, and lymphopenia, carries a high risk of death, finding better methods of vaccination and immunotherapy are of greatest importance.

Prior MHC Class II Peptide Vaccine Studies.

Dr. Brigette Askonas (Imperial College, London) had previously tested T cell lines generated from PBMC from individuals, 3-6 months after influenza infection, with 16 mer peptides, which overlapped by 11 residues (Gelder C Int Immunol. 1998; 10:211-22). The results were correlated with DR histotype. Antibodies to DR, DQ, DP were used to test the restricting locus. Regions with epitopes presented by multiple individuals with differing histotypes were identified (promiscuous epitope verses overlapping epitopes presented by respective alleles), Inspection (p7502 of JV 7497-7506, 1995) indicated some regions with epitopes well presented by many (>60% of subjects) DR types (peptides 92, 205, 295, and others) and regions well presented by fewer (<40% of subjects) DR alleles (peptides starting at residues 187, 252, 407 and others). The narrowest peaks in the histograms contained at least 3 responding peptides. That fact implies a great likelihood of two epitopes being present within a sequence containing 3 overlapping peptides; pinpointing putative MHC II epitopes is not possible by inspection of this data.

Nevertheless, several of the predicted epitopes fall within those peaks of strong responses in some patients, e.g., AEHA-443, -406, -431, and 413.

The Ii-Key/influenza virus MHC class II epitope hybrid peptides can be applied to the diagnosis and therapy of influenza infections. In particular they can be applied in the case of a pandemic mimicking in some ways that of the 1918 flu pandemic. The pattern of deaths in that epidemic was characterized by rapid death (about 48 hr with lungs filled with fluid "drowning") and an with age peak of 15-30 years (instead of customary since-then distribution in a bimodal fashion killing in very young and very old in 7-10 days). This pattern was consistent with a "cytokine storm" response to one or more epitopes in a influenza infection experienced 15+ years before. Only one prior flu serotype has been identified by serotyping of older individuals. In addition, a study by Webster and colleagues on vaccinating pigs with an NS1 DNA indicated a mechanism mechanism of the high virulence of H5N1 influenza viruses in humans and the virulence of 1918 Spanish influenza (Seo S H Virus Res. 2004; 103: 107-13). The H5N1 influenza viruses transmitted to humans in 1997 were highly virulent, but the mechanism of this virulence in humans remains unknown. They showed that lethal H5N1 influenza viruses, unlike other human, avian, and swine influenza viruses, are resistant to the anti-viral effects of interferons and tumor necrosis factor alpha. The nonstructural (NS) gene of H5N1 viruses is associated with this resistance. Pigs infected with recombinant human H1N1 influenza virus that carried the H5N1 NS gene experienced significantly greater and more prolonged viremia, fever, and weight loss than did pigs infected with wild-type human H1N1 influenza virus. Therefore, immunization with hybrids, or hybrids boosting DNA immunizations with genes for HA and or NA (virus envelope targets for neutralizing antibodies) are preferred to immunizations with NS genes, which might be associated with an adverse response which might have an immunological basis. Specifically, vaccination to an internal antigen might yield worse results (greater death rates) in vaccinated people upon exposure to some strains of influenza virus. Testing patients responses with hybrids for various influenza proteins furthermore, can be expected to lead to explanations for an immunologically based pathogenic mechanism, and to therapies to prevent or moderate such a mechanism. In addition, the use of these hybrids, and the use of such hybrids prior to a DNA vaccine, or vaccination with an inactivated or attenuated virus can be expected to broad protection across potential strains of virus and there fore permit a lesser frequency of vaccinations, e.g., one vaccination per 3 years, but at least less than one yearly.

In additional studies Webster and colleagues found no apoptotic deaths and different levels of inductions of inflammatory cytokines in alveolar macrophages of pigs infected with influenza viruses (Seo S H Virology. 2004 Nov. 24; 329(2): 270-279. Influenza viruses infect mainly the respiratory tract epithelium of hosts. Their pig model showed that influenza A viruses infect alveolar macrophages that constitutively reside in the respiratory tract, without causing apoptosis. Tumor necrosis factor alpha was the inflammatory cytokine most highly induced in these macrophages. In vivo, alveolar macrophages infected with human H3N2 influenza virus showed greater expression of tumor necrosis factor alpha than did alveolar macrophages infected with human H1N1 influenza virus. Induction of specific inflammatory cytokine such as TNF-alpha is a polygenic trait that involves the HA and NA genes. Markedly elevated expression of tumor necrosis factor alpha might be responsible for the high mortality rate caused by H3N2 influenza virus infection in elderly patients. Consequently, identification by the methods revealed here, of the H3N2 MHC class II epitopes responsible for protective or deleterious immune responses to H3N2 will lead to better compounds and methods for diagnosis, patient monitoring, and immunotherapy of patients with influenza. Likewise, the Ii-Key/MHC class II hybrids can be used to enhance immunizations against H3N2, or other strains, with adenovirus 5 recombinants (Wesley R D Vaccine. 2004; 22:3427-34.

Immunobiology of Antiviral Immune Responses.

The immune system protects humans from pathogenic processes by recognizing foreignness, for example, a pathogenic influenza virus. An important determinant or epitope of foreignness, for example of the hemagglutinin (HA) protein of influenza virus, is an antibody-recognized determinant (ARD) on the surface of the protein. Often such ARDs are flexible peptidyl loops, which can fold to fit into the binding sites of protective, virus-neutralizing antibodies, which dominate in the protective response. Mutations in the ARDs within the HA of one strain might or might not be recognized by antibodies, which were elicited by a vaccinating strain. Such mutations are referred to as "drift" of the antigenic epitopes within one stain. When an entirely new strain emerges, the ARDs are substantially different; "shift" in the ARDs has occurred. Then, one must have anticipated the emerging strain, if vaccine protection for that season is to be obtained. For this reason, trivalent vaccines are usually created, hoping that one or more of the three strains in the vaccine will afford protection against any strain(s) of flu, which might emerge in the next season.

Although neutralizing antibodies are the principal defense against flu, two additional cell types are essential both for a robust defense and for immunological memory against subsequent infections. Cytotoxic T cells can kill the primarily infected cells, the factories for virus production and release. Helper T cells (Th cells) enhance production of both antibodies and the cytotoxic T cells, and afford memory for 10-30 years. Both of these types of T cells have cell surface receptors (the T cell receptors—TCR), which recognize peptide fragments of the virus proteins, presented by major histocompatibility complex (MHC) molecules of an infected cell. Cytotoxic T cells recognize 9 amino acid peptides presented by MHC class I molecules. The presented peptides are excised from cytoplasmic proteins, e.g., from intracellular virus proteins otherwise destined for viral replication or assembly into infectious particles. Such peptides are digested by proteosomes and moved into the endoplasmic reticulum (ER) by the transporter of antigenic peptides (TAP). In the ER those peptides bind into the antigenic peptide binding site of nascent MHC class I molecules, which are then transported to the cell surface, to display that repertoire of endogenous peptides to T cell surveillance. That process occurs on all nucleated cells of the body and leads to recognition of foreignness, and the death of the factory for virus replication, or site of malignant transformation.

The cells are essential to a robust response and long-termed immunological memory. Th cells recognize 9 amino acid epitopes or segments of longer peptides which bind into the antigenic peptide binding site of MHC class II molecules, with the peptides extending 2 or more amino acids at either end, even out of the open ends of the peptide binding trough. The antigenic peptide-binding site is blocked by the Ii protein at the time of their synthesis in the ER of professional antigen presenting cells. Only a subset of immune system cells, macrophages, dendritic cells, and B lymphocytes express MHC class II molecules. The MHC class II molecules with the site-blocking Ii protein, traffic intracellularly to a post-Golgi compartment where cleavage of Ii protein occurs in a concerted process with binding of processed fragments of foreign antigens. Such foreign antigens can be recognized by antigen-specific mechanisms, such as antibody recognition of ARD. For example, cell surface immunoglobulins on B cells recognize and internalize ARD on antigen, which is digested into fragments presented on the MHC class II molecules of the B cells. Recognition of those peptides by Th cells promotes the maturation and proliferation of the B cells into plasma cells, which produce circulating antibodies. Macrophages or dendritic cells can internalize antigen either via antibody or antibody-bound complement. Alternatively, they can phagocytose particles, having been drawn to the site and activated by certain receptors (toll like receptors, TLR), which are triggered by general chemical structures on the pathogen or antigenic molecule.

Discovery of the Ii-Key Immunoregulatory Segment of the Ii Protein.

The Ii-Key segment of the Ii protein regulates tightness of closure of the antigenic peptide-binding site of MHC class II molecules. That segment was identified because it had 6 positive side chains, no negative side chains, and 4 prolines, which together appeared to constitute a signal for a protease or "exchangease" regulating cleavage and release of Ii protein and antigenic peptide binding. Mutations in this segment blocked the staged cleavage and release of Ii proteins. Many Ii-Key peptide homologs enhanced presentation of synthesized antigenic peptides to murine T hybridomas. Coupling the Ii-Key peptide to an antigenic peptide enhanced presentation about 200 times in vitro. In vivo such compounds enhanced Th1 type responses 8-10 times as judged by IFN-γ ELISPOT assays.

Mechanism of Ii-Key/MHC Class II Epitope Hybrid Peptides.

Ii-Key hybrid peptides enhance the binding of MHC class II epitopes into antigenic binding sites of MHC class II molecules. Ii-Key hybrid peptides are comprised of an Ii-Key core peptide (a regulatory segment of the Ii protein) linked through a polymethylene chain (5-aminopentanoic acid) to the N-terminus of a MHC class II-presented epitope. The hypothesis is that the Ii-Key moiety binds to an allosteric site on the surface of MHC class II molecules near the end of the trough between two α-helices holding the N-terminus of antigenic peptides. The MHC class II epitope of the hybrid then binds into the antigenic peptide binding site and pulls the Ii-Key moiety from its site, since shorter spacers are usually more potent in homologous series varying spacer length. The potency of presentation of an epitope in vitro is enhanced about 200 times relative to the epitope-only peptide. The vaccine response to an Ii-Key hybrid epitope peptide, compared with epitope-only peptide, is 8-10 times greater in IFN-γ ELISPOT assays of affinity-purified CD4+ cells (taking the product of cell number×spot area, which product correlates to ELISA-measured cytokine in culture supernates).

Patient Monitoring with Ii-Key Hybrids to Predict Clinical Course.

The Ii-Key/MHC class II flu H5 hybrids can be used to monitor Th1 versus Th2 response patterns, which might predict clinical outcome. While Ii-Key/MHC class II epitopes of emerging infectious diseases might present a speedier diagnostic reagent (for Th cells at 2-5 days after infection) than available with antibodies (first appearing after 2+ weeks), this is of lesser value in H5 influenza where the clinical presentation is diagnostic in the face an epidemic. However, measuring the relative Th1 versus Th2 cytokine response patterns might help to determine the clinical pattern of the disease within an individual patient. SARS patients dying 7-12 days after infection, when they are no longer contagious and viremia is resolving, often have a Th2 pattern of cytokine response, with relatively elevated IL-10 and IL-4 and less IFN-γ. A cytokine storm, not unlike that occurring in septic shock syndrome, might contribute to death. Ii-Key/MHC class II hybrids might help to diagnose such an event early. A similar event which might occur in H5 flu infections has been suggested.

Therapeutic Vaccine in Some H5 Flu Patients.

Ii-Key/MHC class II hybrids might also be a therapeutic vaccine to convert a Th2 to a Th1 response in selected patients. In immunizing mice with Ii-Key/MHC class II cancer epitope hybrids, strong Th-1 cytokine patterns (high IFN-γ, and low IL-4 and IL-10) were observed in ELISPOT assays of immunoaffinity purified CD4+ T cells. In additional assays with PBMC of some cancer patients, stronger Th1 than Th2 patterns were always observed, excepting that an IL-10 response dominated in one assay with Ii-Key HER-2/neu MHC class II epitope hybrid and PBMC of a breast carcinoma patient. In such a cancer patient, a Th2 pattern (IL-10/IL-4) might indicate poorer prognosis and need for an immunodeviating therapeutic Ii-Key hybrid peptide vaccine. The same approach might be applied in the therapy of asthma.

Use of Ii-Key/MHC class II epitope of H5 hybrids as a prevaccine before other forms of H5N1 vaccination. Ii-Key/MHC class II hybrids might also be used in the following vaccine schemes:

a. as a priming vaccine before a DNA vaccine,
b. as a priming vaccine before an attenuated or killed virus vaccine,
c. as a priming vaccine before an H5 protein vaccine, and
d. for partial protection in the case of limitation in either time or alternate vaccine, in a rapidly progressing pandemic.

These methods of use are described in detail elsewhere.

Mechanism for Enhancement of DNA Vaccines with Ii Suppression by Genetic Constructs or siRNA.

Inhibiting expression of the Ii protein enhances presentation of endogenously synthesized antigens by MHC Class II molecules in APCs. The Ii protein normally binds to MHC Class II molecules in the ER at synthesis. In is digested in a post-Golgi vesicle and released from MHC Class II in a concerted fashion with the charging of antigenic peptides. Ii protects the antigenic peptide binding site on MHC Class II molecules from binding to endogenously derived antigenic peptides in the ER. Those peptides have been processed from cytoplasmic peptides by proteosomes and transplanted by TAP into the ER for binding to MHC Class I molecules. For DNA vaccines, co-suppression of Ii protein in DNA-transfected cells results in the simultaneously presentation of fragments from endogenously synthesized vaccine gene through MHC Class I molecules and "unblocked" MHC Class II molecules (normally MHC Class II molecules are blocked by Ii protein and here Ii protein has been inhibited). Dendritic cell licensing by CD4+ T helper cells enhances CD8+ cytotoxic T cell activation. This principle was first established by demonstrating that tumor cells transfected with exogenous MHC Class II molecules become potent cancer cell vaccines. Specifically, the malignant potential of a transplantable tumor lacking MHC Class II molecules is eliminated by transferring genes for syngeneic MHC Class II molecules (but without the gene for Ii protein) into the tumor cells. Vaccinating mice with this 'genetically engineered' tumor was shown to protect them against subsequent challenge with parental tumor cells. The importance of the Ii protein in blocking this effect was demonstrated by showing that the efficacy of this tumor cell vaccine could be abolished by introducing a gene for the Ii protein. Similarly, attempts to generate cellular vaccines using agents that induce both MHC Class II and Ii protein expression transfection with the MHC Class II transactivator (CIITA) gene) have been unsuccessful. Our own work demonstrates the robust enhancement of vaccines to proteins synthesized from genes of TAA or transfected DNA by Ii suppression in MHC Class II+ and Ii− cells. Experiments are being conducted to test the benefit of Ii suppression by reverse gene or RNAi constructs to enhance melanoma gp100, HIV Gag, and vaccinia gp42(B5R) DNA vaccines. Similar studies with H1, H3 and H5 DNA vaccines will probably demonstrate substantial enhancement of responses to those vaccines.

The process to design and evaluate the use of Ii-Key/influenza HA MHC class II epitope hybrid vaccine peptides in protection against and therapy of influenza is the following.

I. Design of H5, H1, and H3 Ii-Key/MHC Class II Epitope Hybrid Peptides.

Also design H2, H7 and H9 Ii-Key/MHC class II epitope hybrid peptides. These objectives have been accomplished. The Ii-Key/H5 MHC class II epitope hybrid peptides are synthesized and ready for distribution. The H1 peptides have been ordered and will be available for distribution in early February.

II. In Vitro Human Responses to Ii-Key/HA MHC Class II Epitope Hybrid Peptides.

IIA. Responses to H1 and H3 MHC Class II Epitopes.

H1 and H3 hybrids will be tested against PBMC of individuals who had documented vaccinations with Aventis flu trivalent vaccine within the past 2 years or documented infections with either of these strains. The first study is with all peptides, in triplicates, $1 \times 10^6$ cells/well, ELISPOTS for IFN-γ. The second study is with selected peptides, with rH1 protein- or rH3 protein-stimulated, 12-days cultured cells, at $2 \times 10^6$ cells/well, and with DC, which have been cultured from the first sample. The expected results: 10-20 cells/well reponses in the first assay with >6 positive peptides, varying according to HLA-DR genotypes; with substantial increases in the cells/well in stimulated cultures. DNA buttons will be kept for DR-genotyping.

IIB. Defining Epitope Sequence of the Best Hybrids.

Toward optimizing Ii-Key hybrids structures for a clinical trial, homologs of most potent and promiscuous Ii-Key/H1 and -H3 hybrids with nested N-terminal deletions of the segment containing the antigenic epitope will be assayed against PBMC of DR-genotyped individuals. These assays will determine the P1 site residue and respective HLA-DR restriction of a single or closely overlapping epitopes in potent, promiscuous hybrids of IIA. The goal is to be able to select a basket of 4 to 7 hybrids for clinical trials.

I. Test of H5 Hybrids Against PBMC of Individuals with Suggestive Serological Responses to H5 Flu.

II. Test of Mice Immunized with H1 or H5 Recombinant Protein [or with a Viral Vaccine].

The Ii-Key/MHC class II epitope hybrids will be assayed against splenic or lymph node lymphocytes of mice immunized with HA recombinant protein. rH1 protein-immunized mice will be tested with H1 hybrids, plus selected H5 or other hybrids for antigenic specificity controls. After selection of strongly reaction hybrids, preferably ones which also show strong biological activity in humans exposed to the same antigenic sequence through vaccination or infection, additional studies will be undertaken to determine the dose, dosage schedule, and immunization protocol in which a basket of H1 (or H5) Ii-Key/MHC class II epitope hybrids can be used to prime for a single immunization with rH1 protein. One would like to determine whether priming with Ii-Key hybrids permits a lower dose of H1 to be administered, than that expected to given a robust vaccination response when used alone, with two sequential immunizations.

Test of Mice Immunized with H1 or H5 DNA, without or with Ii Suppression Using Genetic Constructs or siRNA.

The immune response to DNA vaccines will be enhanced by injecting a DNA vaccine for B5R along with either Ii-RGC, to suppress Ii protein in dendritic cells, or along with both Ii-RGC and CIITA to induce the MHC Class II+, Ii− phenotype in keratinocytes, skeletal muscle or other cells. Responses may be measured at a cellular level and/or by antibodies.

Plasmids will be constructs containing: a) the H1 gene, or fragments thereof, b) the H1 gene, or fragments thereof, and either murine or human Ii-RGC or murine or human Ii-RNAi, c) the H1 gene, or fragments thereof, and either murine or human Ii-RGC or murine or human Ii-RNAi, and the CIITA gene, d) appropriate control sequences. These genes may be under the control of CMV, vaccinia or other promoters. These may be characterized by gene sequencing, and by induction of the H1 protein and suppression of Ii in tests cells such as COS. The immunogenicity of such constructs in BALB/c mice (or other strains) may be measured by ELISA to recombinant H1 protein and by ELISPOT to putative MHC Class II- and MHC Class I-presented peptides. Initially these constructs may be prepared with the murine Ii-RGC [or the human Ii-RGC reagent may be considered to be a control plasmid in murine studies]. In the event that good cellular but not humoral responses are elicited, a final boost with recombinant H1 protein may be given. In that case, a hemagglutinin assay can also be performed. The goal is to establish optimal dose, dose schedule, formulation, and route for this vaccination protocol.

Collaborators may confirm these experiments, and furthermore test the use of such DNA vaccines prior to challenge with influenza virus.

IV. Test of the Efficacy of H1 or H5 Used as a Prevaccine to Augment the Vaccine Response to H1 or H5 DNA Vaccine, Respectively.

Optimal dose and dosage schedule established in IV will be used to prime mice before the optimal DNA vaccination protocol established under V.

V. Creation and Testing of Minigenes Encoding the Sequence of Ii-Key/Influenza H1 Antigenic Epitope Hybrids.

Minigenes coding for the sequence of a MHC Class II-presented epitope are a potent DNA vaccine or can enhance responses to various subsequent influenza H1 vaccines. Minigenes coding for potent MHC Class II epitopes can be created and tested as immunogens: a) alone, b) priming for a DNA vaccine for the sequence containing the MHC Class II epitope, and c) after incorporation into one plasmid with a DNA vaccine for the sequence containing the MHC Class II epitope. Collaborators may repeat the above studies and extend the studies to enhance protection by influenza vaccine and to protect against influenza virus challenge.

VI. Clinical Trials.

Clinical trials will only be considered after the information from the above studies is available and evaluated, by persons skilled in this type of trials. Nevertheless, certain questions for those trials can be posed by the preclinical scientists.

1. What are optimal dose and dosage schedule, and adjuvant to elect a strong Th1 response in either a naïve individual or a person with prior immunization with the epitope of interest? The first trial might be dose-ranging and with variable numbers of booster injections. One needs to decide if the earliest trial is with each Ii-Key hybrid or a mixture of all 4 to 7, which might be in the basket for a large-scale efficacy trial.

2. What effect on a subsequent inactivated or attenuated viral immunization does priming with the basket of hybrids have?
3. What effect on a subsequent DNA vaccination with the corresponding HA DNA, does priming with hybrids have?
4. What benefit upon exposure to infection does immunization procedures 2 or 3 have?
Choice of sequences of H5, H1, H3 and of H7, H9, H2 for comparisons.

HLA-DR-presented epitopes were predicted for the following HA sequences. The sequences were chosen on the basis of being on currently circulating strains. The alignments of deduced amino acid sequences are according to Skehel.

TABLE 30.1

Analyzed influenza HA sequences.

| Strain Type | Why Chosen | Sequence Origin |
|---|---|---|
| H5N1 (A/Duck/Anyang/AVL-1/2001) | Pathogenic index strain | Genbank (GI: 21359660) |
| H1N1 (A/New Caledonia/20/99) | H1 strain in the 2004-2005 Aventis Flu Vaccine | Genbank (GI: 19849784) |
| H3N2 (A/Aichi/2/68) | Representative Strain on flu website | Genbank (GI: 538597) |
| H7N3 (A/chicken/BritishColumbia/04) | Representative Strain on flu website | Genbank (GI: 50542636) |
| H9N2 (A/HongKong/1074/99) | Representative Strain on flu website | Genbank (GI: 8894695) |
| H2N2 (A/Japan/305/57) | Representative Strain on flu website | Genbank (GI: 305155) |

The protocol followed in designing Ii-Key/influenza MHC class II vaccine peptides for this study follows.

Some peptides of an influenza protein, e.g., hemagglutinin H5, might be reported in the literature to be recognized by human CD4+ T cells, i.e., those peptides contain MHC class II epitopes. Such a peptide is incorporated in an Ii-Key/MHC class II epitope hybrid, and homologs of that hybrid are also synthesized, containing nested deletions of N-terminal amino acids of the epitope-containing segment. Testing such homologs as a function of HLA-DR genotype of responding humans, identifies the P1 site residue of each incorporated MHC class II epitope, and possibly of overlapping epitopes (with different HLA-DR restrictions). If such experimentally established MHC class II epitopes are not available (as appears to be the case now), the following protocol is followed to predict and then evaluate MHC class II epitopes.

The sequence of an influenza protein of interest is obtained from PubMed/Genbank (www.ncbi.nlm.nih.gov/entrez/query.fcgi) or fluweb (www.flu/lanl.gov/).

Predicted HLA-DRB1 epitopes (for alleles DRB1*0101, DRB1*0301, DRB1*0401, DRB1*0701, DRB1*1101 and DRB1*1501) are identified by application of the Rammensee SYFPEITHI program (access at: www.syfpeithi.de) to the sequence of the antigenic protein of interest. The results are presented and analyzed in the following series of Tables.

Table 30.H5.1 presents the 50 top-scoring predicted epitopes for each DR allele in respective columns, ranked according to the score reported from the SYFPEITHI program. In the case of sequences of less than 150 amino acids, the number of predicted epitopes can be limited to 40.

Table 30.H5.2 presents the 50 highest ranking predicted epitopes across all examined alleles. Note in the example, the precession of first ranked (1), then second ranked (2), etc. predictions across the columns, moving downward within the table. Whenever a given epitope is within the top 50 epitopes predicted to be presented by one or more DR alleles, the ranking of that predicted epitope within the additional one or more DR alleles is listed. In some cases, an epitope predicted for presentation by a second allele overlaps the reported high-coring MHC class II allele offset by only one or two amino acids. When the second epitope extends 1 or 2 amino acids C-terminal to the reference epitope, then "+1" or "+2" respectively is given in the overlap-scoring column. When the second epitope extends 1 or 2 amino acids N-terminal to the reference epitope, then "−1" or "−2" respectively is given in the overlap-scoring column. Because Ii-Key hybrid peptides are synthesized with two flanking amino acids of the primary sequence at both N- and C-termini of the epitope additional epitopes including such flanking amino acids might be present. In general, one observes that many high scoring epitopes might be presented by more than one HLA-DR allele. Such hybrids are likely to be "promiscuous" either because one epitope is presented by multiple HLA-DR alleles, and/or because two or more closely overlapping epitopes (presented by difference HLA-DR alleles) are present within the 2+9+2=13 amino acids of the epitope-containing segment of the Ii-Key hybrid peptide.

Table 30.H5.3 presents the sequences of Ii-Key/influenza MHC class II epitope hybrid peptides, which might be proposed for synthesis. From the following analysis, the actual peptides recommended for synthesis are chosen (and transcribed to Table IV). The first column of Table III contains the position number of the first amino acid in the predicted MHC class II epitope. The second column contains the N-terminal blocking group (here acetyl, Ac). The third column contains the Ii-Key motif and linker (here LRMK (SEQ ID NO.: 3) Ii-Key core sequence and ava=aminovaleric acid=5-amino-pentanoic acid). The fourth column contains the N-terminal flanking two amino acids (f-N). The fifth column contains the predicted MHC class II-presented 9-amino-acid epitope. The sixth column contains the C-terminal flanking two amino acids (f-C). The seventh column contains the C-terminal blocking group (here amide, —NH$_2$). The eighth column contains the number of amino acids in the epitope plus two flankers, of the group leucine, isoleucine, valine, phenylalanine, and methionine (LIVFM; SEQ ID NO.: 790). Peptides with 5 or more members of this group of long or bulky side chain hydrophobic residues are rejected for synthesis in anticipation of relative insolubility. The ninth column reports the number of residues in the epitope, which are asparagine (N) or glutamine (Q), amino acids with amidated side chains. If a hybrid with such a residue is biologically active, then the corresponding homologs of the deamidated amino acids, aspartic acid or glutamic acid will be synthesized and tested, under the hypothesis that in vivo processing of MHC class II epitopes-containing peptides can involve deamidating the side chains. The tenth column reports the occurrence of cysteines in the epitope sequence. Such cysteines contain sulfhydryl groups, which might become oxidized to sulfoxides upon storage or use of a peptide vaccine formulation, or during processing of antigenic peptide fragments. If such a peptide is biologically active, then such issues will be addressed. The eleventh column reports the selection of peptides to be synthesized (Y) or not (N).

Table 30.H5.4 presents the final selection of Table 30.H5.3 peptides. In the case of peptide with P1 site residues differing by only one or two amino acids, such extensions by lower ranking sequences of the Table are added to the respective N- or C-termini of the highest ranks members of such overlapping predictions.

The best Ii-Key/MHC class II epitope hybrids for immunological studies, leading to selection of a basket of peptides are the following.

H5
Introduction:
LOCUS       AAM49555                 568 aa            linear   VRL 09-JUN-2002
DEFINITION  hemagglutinin H5
            [Influenza A virus (A/Duck/Anyang/AVL-1/2001(H5N1))].
ACCESSION   AAM49555
VERSION     AAM49555.1  GI: 21359660
DBSOURCE    accession AF468837.1
REFERENCE   1  (residues 1 to 568)
AUTHORS     Tumpey, T. M., Suarez, D. L., Perkins, L. E., Senne, D.
A., Lee, J. G., Lee, Y. J., Mo, I. P., Sung, H. W. and Swayne, D. E.
TITLE       Characterization of a highly pathogenic
H5N1 avian influenza A virus isolated from duck meat
JOURNAL     J. Virol. 76 (12), 6344-6355 (2002)
MEDLINE     22016166
PUBMED      12021367

(SEQ ID NO.: 1154)

```
  1 mekivlllai vslyksdqic igyhannste qvdtimeknv tythaqdile kthngklcdl 61 dgvkplilrd csvagwllgn pmcdefinvp ewsyivekan pandlcypgd fndyeelkhl 121 lsrinhfeki qiipksswsn heassgvssa cpyngkssff rnviwlikkn sayptikrsy 181 nntnqedlli lwgihhpnda aeqklyqnp ttyisvgtst lnqrlypkia trskyngqsg 241 rmeffwtilk pndtinfesn gnfiapeyay kivkkgdsai mkseleygnc ntkcqtpmga 301 inssmpfhni hpltigecpk yvksnrlvla tglrntpqre rrrkkrglfg aiagfieggw 361 qgmvdgwygy hhsneqgsgy aadkestqka idgvtnkvns iidkmntqfe avgrefnnle 421 rrienlnkkm edgfldvwty naellvlmen ertldfhdsn yknlydkvrl qlrdnakelg 481 ngcfefyhkc dnecmegvkn gtydypryse earlnreeis gvklesmgty qilsiystva 541 sslalaimva glslwmcsng slqcrici
```

TABLE 30.H5.1

| | Rammensee algorithm-selected H5 MHC class II epitopes | | | | | |
|---|---|---|---|---|---|---|
| | 0101 | 0301 | 0401 | 0701 | 1101 | 1501 | $E^k$ |
| 1 | 1 | 443 | 111 | 46 | 111 | 239 | 441 |
| 2 | 54 | 252 | 170 | 29 | 267 | 530 | 4 |
| 3 | 542 | 551 | 210 | 177 | 160 | 121 | 118 |
| 4 | 210 | 46 | 406 | 210 | 161 | 524 | 213 |
| 5 | 304 | 398 | 431 | 529 | 413 | 108 | 223 |
| 6 | 431 | 461 | 533 | 8 | 170 | 361 | 458 |
| 7 | 533 | 492 | 4 | 37 | 242 | 434 | 330 |
| 8 | 8 | 64 | 8 | 203 | 406 | 86 | 1 |
| 9 | 521 | 83 | 114 | 270 | 533 | 1 | 10 |
| 10 | 529 | 423 | 118 | 304 | 7 | 4 | 29 |
| 11 | 57 | 2 | 223 | 318 | 431 | 33 | 54 |
| 12 | 243 | 11 | 239 | 435 | 469 | 54 | 124 |
| 13 | 267 | 246 | 388 | 453 | 542 | 57 | 157 |
| 14 | 295 | 310 | 529 | 484 | 61 | 64 | 173 |
| 15 | 322 | 519 | 20 | 521 | 90 | 70 | 185 |
| 16 | 185 | 55 | 89 | 532 | 118 | 167 | 349 |
| 17 | 189 | 57 | 91 | 545 | 127 | 185 | 388 |
| 18 | 5 | 465 | 104 | 3 | 188 | 186 | 462 |
| 19 | 91 | 468 | 124 | 4 | 226 | 207 | 536 |
| 20 | 111 | 92 | 157 | 10 | 326 | 298 | 45 |
| 21 | 222 | 117 | 177 | 83 | 420 | 301 | 282 |
| 22 | 342 | 161 | 204 | 89 | 465 | 324 | 309 |
| 23 | 2 | 226 | 243 | 162 | 1 | 343 | 312 |
| 24 | 37 | 278 | 254 | 214 | 5 | 403 | 403 |
| 25 | 160 | 359 | 267 | 223 | 54 | 410 | 410 |
| 26 | 261 | 434 | 284 | 246 | 318 | 536 | 417 |
| 27 | 270 | 441 | 304 | 269 | 529 | 545 | 451 |
| 28 | 465 | 442 | 318 | 295 | 89 | 549 | 502 |
| 29 | 530 | 444 | 365 | 345 | 243 | 553 | 2 |
| 30 | 71 | 445 | 377 | 357 | 295 | 254 | 5 |
| 31 | 114 | 452 | 413 | 367 | 357 | 304 | 7 |
| 32 | 163 | 467 | 437 | 391 | 364 | 481 | 8 |
| 33 | 204 | 532 | 484 | 431 | 481 | 2 | 57 |
| 34 | 232 | 7 | 505 | 433 | 505 | 5 | 60 |
| 35 | 292 | 75 | 527 | 443 | 30 | 10 | 83 |
| 36 | 345 | 160 | 1 | 445 | 91 | 80 | 89 |
| 37 | 346 | 162 | 2 | 533 | 157 | 118 | 114 |
| 38 | 434 | 173 | 3 | 534 | 204 | 154 | 121 |
| 39 | 532 | 214 | 5 | 536 | 216 | 226 | 127 |
| 40 | 536 | 276 | 7 | 551 | 254 | 240 | 130 |

TABLE 30.H5.2

Highest ranking H5 MHC class II epitopes

| AEHA | 0101 | 0301 | 0401 | 0701 | 1101 | 1501 | E^k |
|---|---|---|---|---|---|---|---|
| 1 | 1 | +1 | 36 | +2 | 23 | 9 | 8 |
| 443 |  | 1 |  | 35 |  |  | −2 |
| 111 | 20 |  | 1 |  | 1 |  |  |
| 46 |  | 4 |  | 1 |  |  | −1 |
| 239 |  |  | 12 |  |  | 1 |  |
| 54 | 2 |  | +1 |  | 25 | 12 | 11 |
| 252 |  | 2 |  | +2 |  | +2 |  |
| 170 |  |  | 2 |  | 6 |  |  |
| 29 |  |  |  | 2 |  | +1 | 10 |
| 267 | 13 |  | 25 |  | +2 | 2 |  |
| 530 | 29 | +2 | −1 | +2 | −1 | 2 |  |
| 542 | 3 |  |  |  | 13 |  |  |
| 551 |  | 3 |  | 40 |  | −2 |  |
| 210 | 4 |  | 3 | 4 |  |  |  |
| 177 |  |  | 21 | 3 |  |  |  |
| 160 | 25 |  | +1 |  | +2 | 3 |  |
| 121 |  |  |  |  |  | 3 | 38 |
| 406 |  |  | 4 |  | 8 |  |  |
| 161 |  | −1 | 22 |  | +1 | 4 |  |
| 524 |  |  |  |  |  | 4 |  |
| 304 | 5 |  | 27 | 10 |  |  |  |
| 398 |  | 5 |  |  |  |  |  |
| 431 | 6 |  | 5 | 33 | 11 |  |  |
| 529 | 10 |  | 14 | 5 | 27 | +1 |  |
| 413 |  |  | 31 |  | 5 |  |  |
| 108 |  |  |  |  |  | 5 |  |
| 461 |  | 6 |  |  |  |  | +1 |
| 533 | 7 | −1 | 6 |  | −1 | 9 |  |
| 8 | 8 | −1 | 8 | +2 | −1 | +2 | 32 |
| 170 |  |  | 2 |  | 6 |  |  |
| 361 |  | −2 |  |  |  | 6 |  |

TABLE 30.H5.3

Proposed Ii-Key/H5 MHC class II epitope hybrid peptides peptides (SEQ ID NOS: 1155-1184, respectively, in order of appearance.)

| AEHA | N-term | f-N | Epitope | f-C | C-term | LIVFM | NQ | C | Syn |
|---|---|---|---|---|---|---|---|---|---|
| 1 | Ac— | LRMK-ava TG | MEKIVLLLA | IV | —NH₂ | 8 | 0 |  | N |
| 443 | Ac— | LRMK-ava NA | ELLVLMENE | RT | —NH₂ | 5 | 1 |  | Y |
| 111 | Ac— | LRMK-ava GD | FNDYEELKH | LL | —NH₂ | 4 | 1 |  | Y |
| 46 | Ac— | LRMK-ava HA | QDILEKTHN | GK | —NH₂ | 2 | 2 |  | Y |
| 239 | Ac— | LRMK-ava CQ | SGRMEFFWT | IL | —NH₂ | 5 | 0 | + | N |
| 54 | Ac— | LRMK-ava TH | NGKLCDLDG | VK | —NH₂ | 3 | 1 |  | Y |
| 252 | Ac— | LRMK-ava KP | NDTINFESN | GN | —NH₂ | 2 | 3 |  | Y |
| 170 | Ac— | LRMK-ava KK | NSAYPTIKR | SY | —NH₂ | 1 | 1 |  | Y |
| 29 | Ac— | LRMK-ava NS | TEQVDTIME | KN | —NH₂ | 3 | 1 |  | Y |
| 267 | Ac— | LRMK-ava AP | EYAYKIVKK | GD | —NH₂ | 2 | 0 |  | Y |
| 530 | Ac— | LRMK-ava TY | YQILSIYST | VA | —NH₂ | 4 | 1 |  | Y |
| 542 | Ac— | LRMK-ava AS | SLALAIMVA | GL | —NH₂ | 6 | 0 |  | N |
| 551 | Ac— | LRMK-ava VA | GLSLWMCSN | GS | —NH₂ | 4 | 0 | + | N |
| 210 | Ac— | LRMK-ava QN | PTTYISVGT | ST | —NH₂ | 2 | 0 |  | Y |
| 177 | Ac— | LRMK-ava TI | KRSYNNTNQ | ED | —NH₂ | 1 | 4 |  | Y |
| 160 | Ac— | LRMK-ava SF | FRNVIWLIK | KN | —NH₂ | 6 | 1 |  | N |
| 121 | Ac— | LRMK-ava HL | LSRINHFEK | IQ | —NH₂ | 4 | 1 |  | Y |
| 406 | Ac— | LRMK-ava KM | NTQFEAVGR | EF | —NH₂ | 4 | 2 |  | Y |
| 161 | Ac— | LRMK-ava FF | RNVIWLIKK | NS | —NH₂ | 6 | 1 |  | N |
| 524 | Ac— | LRMK-ava VK | LESMGTYQI | LS | —NH₂ | 4 | 1 |  | Y |
| 304 | Ac— | LRMK-ava NS | SMPFHNIHP | LT | —NH₂ | 3 | 1 |  | Y |
| 398 | Ac— | LRMK-ava NK | VNSIIDKMN | TQ | —NH₂ | 4 | 2 |  | Y |
| 431 | Ac— | LRMK-ava KM | EDGFLDVWT | YN | —NH₂ | 3 | 0 |  | Y |
| 529 | Ac— | LRMK-ava MG | TYQILSIYS | TV | —NH₂ | 3 | 1 |  | Y |
| 413 | Ac— | LRMK-ava AV | GREFNNLER | RI | —NH₂ | 3 | 2 |  | Y |
| 108 | Ac— | LRMK-ava CY | PGDFNDYEE | LK | —NH₂ | 1 | 1 | + | Y |
| 461 | Ac— | LRMK-ava SN | VKNLYDKVR | LQ | —NH₂ | 3 | 1 |  | Y |
| 533 | Ac— | LRMK-ava QI | LSIYSTVAS | SL | —NH₂ | 5 | 0 |  | N |
| 8 | Ac— | LRMK-ava VL | LAIVSLVKS | DQ | —NH₂ | 7 | 0 |  | N |
| 361 | Ac— | LRMK-ava GW | QGMVDGWYG | YH | —NH₂ | 2 | 1 |  | Y |

TABLE 30.H5.4

Ii-Key/H5 MHC class II
epitope hybrids peptides for synthesis

| AEHA | N-term | Spacer | f-N | Epitope | f-C | C-term | SEQ ID NO |
|---|---|---|---|---|---|---|---|
| 443 | Ac— | LRMK-ava | NA | ELLVLMENE | RT | —NH$_2$ | 1185 |
| 111 | Ac— | LRMK-ava | GD | FNDYEELKH | LL | —NH$_2$ | 1186 |
| 239 | Ac— | LRMK-ava | CQ | SGRMEFFWT | IL | —NH$_2$ | 1187 |
| 54 | Ac— | LRMK-ava | TH | NGKLCDLDG | VK | —NH$_2$ | 1188 |
| 252 | Ac— | LRMK-ava | KP | NDTINFESN | GN | —NH$_2$ | 1189 |
| 170 | Ac— | LRMK-ava | KK | NSAYPTIKR | SY | —NH$_2$ | 1190 |
| 29 | Ac— | LRMK-ava | NS | TEQVDTIME | KN | —NH$_2$ | 1191 |
| 267 | Ac— | LRMK-ava | AP | EYAYKIVKK | GD | —NH$_2$ | 1192 |
| 530 | Ac— | LRMK-ava | TY | YQILSIYST | VA | —NH$_2$ | 1193 |
| 551 | Ac— | LRMK-ava | VA | GLSLWMCSN | GS | —NH$_2$ | 1194 |
| 210 | Ac— | LRMK-ava | QN | PTTYISVGT | ST | —NH$_2$ | 1195 |
| 177 | Ac— | LRMK-ava | TI | KRSYNNTNQ | ED | —NH$_2$ | 1196 |

TABLE 30.H5.4-continued

Ii-Key/H5 MHC class II
epitope hybrids peptides for synthesis

| AEHA | N-term | Spacer | f-N | Epitope | f-C | C-term | SEQ ID NO |
|---|---|---|---|---|---|---|---|
| 160 | Ac— | LRMK-ava | SF | FRNVIWLIK | KN | —NH$_2$ | 1197 |
| 121 | Ac— | LRMK-ava | HL | LSRINHFEK | IQ | —NH$_2$ | 1198 |
| 406 | Ac— | LRMK-ava | KM | NTQFEAVGR | EF | —NH$_2$ | 1199 |
| 524 | Ac— | LRMK-ava | VK | LESMGTYQI | LS | —NH$_2$ | 1200 |
| 304 | Ac— | LRMK-ava | NS | SMPFHNIHP | LT | —NH$_2$ | 1201 |
| 398 | Ac— | LRMK-ava | NK | VNSIIDKMN | TQ | —NH$_2$ | 1202 |
| 431 | Ac— | LRMK-ava | KM | EDGFLDVWT | YN | —NH$_2$ | 1203 |
| 529 | Ac— | LRMK-ava | MG | TYQILSIYS | TV | —NH$_2$ | 1204 |
| 413 | Ac— | LRMK-ava | AV | GREFNNLER | RI | —NH$_2$ | 1205 |
| 108 | Ac— | LRMK-ava | CY | PGDFNDYEE | LK | —NH$_2$ | 1206 |
| 461 | Ac— | LRMK-ava | SN | VKNLYDKVR | LQ | —NH$_2$ | 1207 |
| 361 | Ac— | LRMK-ava | GW | QGMVDGWYG | YH | —NH$_2$ | 1208 |

```
H1
Introduction:
LOCUS      CAC86622    564 aa  linear  VRL 04-APR-2002
DEFINITION  hemagglutinin
[Influenza A virus (A/New Caledonia/20/99(H1N1))].
ACCESSION   CAC86622
VERSION     CAC86622.1  GI: 19849784
DBSOURCE    embl locus INA344014, accession AJ344014.1
REFERENCE   1
AUTHORS     Marozin, S., Gregory, V., Cameron, K., Bennett, M.,
Valette, M., Aymard, M., Foni, E., Barigazzi, G., Lin, Y. and Hay,
A.
TITLE       Antigenic and genetic diversity among swine influenza
A H1N1 and H1N2 viruses in Europe
JOURNAL     J. Gen. Virol. 83 (Pt 4), 735-745 (2002)
MEDLINE     21904432
PUBMED      11907321
```

(SEQ ID NO.: 1209)

```
  1 mkakllvllc tftatyadti cigyhannst dtvdtvlekn vtvthsvnll edshngklcl
 61 lkgiaplqlg ncsvagwilg npecellisk eswsyivetp npengtcypg yfadyeelre
121 qlssyssfer feifpkessw pnhtvtgvsa scshngkssf yrnllwltgk nglypnlsks
181 yynnkekevl vlwgvhhppn igdqralyht enayvsvvss hysrrftpei akrpkyrdqe
241 grinyywtll epgdtiifea ngnliapwya falsrgfgsg iitsnapmde cdakcqtpqg
301 ainsslpfqn vhpvtigecp kyvrsaklrm vtglrnipsi qsrglfgaia gfieggwtgm
361 vdgwygyhhq neqgsgyaad qkstqnaing itnkynsvie kmntqftavg kefnklerrm
421 enlnkkvddg fldiwtynae llvllenert ldfhdsnykn lyekyksqlk nnakeigngc
481 fefyhkcnne cmesvkngty dypkyseesk lnrekidgyk lesmgvyqil aiystvassl
541 vllvslgais fwmcsngslq cric
```

TABLE 30.H1.1

| Rammensee algorithm-selected H1 MHC class II epitopes | | | | | | |
|---|---|---|---|---|---|---|
| | 0101 | 0301 | 0401 | 0701 | 1101 | 1501 |
| 1 | 537 | 75 | 131 | 38 | 403 | 262 |
| 2 | 540 | 162 | 428 | 5 | 410 | 527 |
| 3 | 55 | 197 | 459 | 204 | 128 | 122 |
| 4 | 3 | 440 | 530 | 266 | 171 | 240 |
| 5 | 142 | 253 | 3 | 334 | 112 | 521 |
| 6 | 334 | 395 | 46 | 47 | 158 | 6 |
| 7 | 115 | 489 | 122 | 428 | 188 | 125 |
| 8 | 305 | 46 | 189 | 9 | 428 | 358 |
| 9 | 331 | 47 | 212 | 219 | 54 | 431 |
| 10 | 428 | 179 | 253 | 526 | 267 | 3 |
| 11 | 523 | 458 | 328 | 530 | 327 | 34 |
| 12 | 530 | 548 | 331 | 13 | 417 | 38 |
| 13 | 58 | 5 | 334 | 36 | 466 | 55 |
| 14 | 268 | 38 | 385 | 162 | 142 | 58 |
| 15 | 526 | 84 | 439 | 178 | 189 | 71 |
| 16 | 212 | 311 | 526 | 211 | 223 | 109 |
| 17 | 223 | 441 | 537 | 319 | 319 | 119 |
| 18 | 266 | 462 | 21 | 350 | 328 | 164 |
| 19 | 515 | 516 | 90 | 432 | 354 | 168 |
| 20 | 9 | 540 | 112 | 450 | 462 | 186 |
| 21 | 244 | 58 | 125 | 481 | 537 | 187 |
| 22 | 112 | 76 | 128 | 529 | 212 | 198 |
| 23 | 171 | 170 | 171 | 548 | 526 | 208 |
| 24 | 205 | 262 | 205 | 11 | 3 | 299 |
| 25 | 233 | 438 | 211 | 26 | 31 | 302 |
| 26 | 270 | 40 | 244 | 30 | 55 | 325 |

TABLE 30.H1.1-continued

| Rammensee algorithm-selected H1 MHC class II epitopes | | | | | | |
|---|---|---|---|---|---|---|
| | 0101 | 0301 | 0401 | 0701 | 1101 | 1501 |
| 27 | 339 | 83 | 255 | 58 | 90 | 328 |
| 28 | 364 | 93 | 266 | 75 | 161 | 331 |
| 29 | 6 | 215 | 305 | 84 | 211 | 340 |
| 30 | 161 | 247 | 362 | 86 | 244 | 400 |
| 31 | 164 | 327 | 374 | 90 | 265 | 523 |
| 32 | 325 | 334 | 403 | 93 | 331 | 537 |
| 33 | 328 | 356 | 410 | 145 | 361 | 546 |
| 34 | 510 | 431 | 434 | 163 | 374 | 550 |
| 35 | 527 | 439 | 481 | 170 | 478 | 128 |
| 36 | 81 | 442 | 524 | 215 | 502 | 255 |
| 37 | 91 | 449 | 548 | 246 | 523 | 268 |
| 38 | 186 | 529 | 2 | 247 | 205 | 305 |
| 39 | 190 | 30 | 6 | 253 | 255 | 478 |
| 40 | 219 | 122 | 17 | 254 | 343 | 40 |
| 41 | 254 | 163 | 19 | 277 | 459 | 155 |
| 42 | 262 | 203 | 30 | 320 | 530 | 192 |
| 43 | 293 | 204 | 38 | 331 | 227 | 241 |
| 44 | 342 | 227 | 44 | 342 | 242 | 247 |
| 45 | 343 | 313 | 47 | 354 | 243 | 279 |
| 46 | 431 | 413 | 58 | 388 | 268 | 337 |
| 47 | 459 | 420 | 85 | 430 | 305 | 346 |
| 48 | 529 | 473 | 93 | 440 | 364 | 351 |
| 49 | 539 | 19 | 115 | 442 | 458 | 407 |
| 50 | 30 | 108 | 119 | 531 | 512 | 425 |

TABLE 30.H1.2

| Highest ranking H1 MHC class II epitopes | | | | | | | | | | | | |
|---|---|---|---|---|---|---|---|---|---|---|---|---|
| | 0101 | | 0301 | | 0401 | | 0701 | | 1101 | | 1501 | |
| 537 | 1 | | | | 17 | | | | 21 | | 32 | |
| 75 | | | 1 | | | | 28 | | | | | |
| 131 | | | | | 1 | | | | | | | |
| 38 | | | 14 | | 43 | | 1 | | | | 12 | |
| 403 | | | | | 32 | | | | 1 | | | |
| 262 | 42 | | 24 | | | | | | | | 1 | |
| 540 | 2 | | 20 | | | | | | | | | |
| 162 | | −1/+2 | 2 | | | | 14 | | | −1 | | +2 |
| 428 | 10 | | | | 2 | | 7 | | 8 | | | |
| 5 | | −2/+1 | 13 | | | −2/+1 | 2 | | | −2 | | −2/+1 |
| 410 | | | | | 33 | | | | 2 | | | |
| 527 | 35 | | | +2 | | −1 | | −1/+2 | | −1 | 2 | |
| 55 | 3 | | | | | | | | 26 | | 13 | |
| 197 | | | 3 | | | | | | | | | +1 |
| 459 | 47 | | | −1 | 3 | | | | 41 | | | |
| 204 | | +1 | 43 | | | +1 | 3 | | | +1 | | |
| 128 | | | | | 22 | | | | 3 | | 35 | |
| 122 | | | 40 | | 7 | | | | | | 3 | |
| 3 | 4 | | | +2 | 5 | | | +2 | 24 | | 10 | |
| 440 | | | 4 | | | −1 | 48 | | | | | |
| 530 | 12 | | | −1 | 4 | | 11 | | 42 | | | |
| 266 | 18 | | | | 28 | | 4 | | | −1/+1 | | +2 |
| 171 | 23 | | | −1 | 23 | | | −1 | 4 | | | |
| 240 | | | | | | | | | | +2 | 4 | |
| 142 | 5 | | | | | | | | 14 | | | |
| 253 | | +1 | 5 | | 10 | | 39 | | | | | +2 |
| 334 | 6 | | 32 | | 13 | | 5 | | | | | |
| 112 | 22 | | | | 20 | | | | 5 | | | |
| 521 | | +2 | | | | | | | | +2 | 5 | |
| 395 | | | 6 | | | | | | | | | |
| 46 | | | 8 | | 6 | | | +1 | | | | |
| 47 | | | 9 | | 45 | | 6 | | | | | |
| 158 | | | | | | | | | 6 | | | |
| 6 | 29 | | | −1 | 39 | | | −1 | | | 6 | |

TABLE 30.H1.3

Proposed Ii-Key/H1 MHC class II epitope hybrid peptides peptides (SEQ ID NO: 1210-1243, respectively, in order of appearance.)

| AEHA | ermterm | Spacer | f-N | Epitope | f-C | C-term | LIVFM | NQ | C | Syn |
|------|---------|--------|-----|---------|-----|--------|-------|----|---|-----|
| 537  | Ac—     | LRMK-ava | TV | ASSLVLLVS | LGAIS | —NH$_2$ | 6 | 0 |   | N |
| 75   | Ac—     | LRMK-ava | SV | AGWILGNPE | CE | —NH$_2$ | 3 | 1 | + | Y |
| 131  | Ac—     | LRMK-ava | SSF | FEIFPKESS | WPER | —NH$_2$ | 3 | 0 |   | Y |
| 38   | Ac—     | LRMK-ava | VL | EKNVTVTHS | VN | —NH$_2$ | 5 | 2 |   | N |
| 403  | Ac—     | LRMK-ava | KM | NTQFTAVGK | EF | —NH$_2$ | 4 | 2 |   | Y |
| 262  | Ac—     | LRMK-ava | AN | GNLIAPWYA | FA | —NH$_2$ | 3 | 2 |   | Y |
| 540  | Ac—     | LRMK-ava | SS | LVLLVSLGA | IS | —NH$_2$ | 7 | 0 |   | N |
| 162  | Ac—     | LRMK-ava | FY | RNLLWLTGK | NG | —NH$_2$ | 4 | 2 |   | Y |
| 428  | Ac—     | LRMK-ava | KV | DDGFLDIWT | YN | —NH$_2$ | 4 | 1 |   | Y |
| 5    | Ac—     | LRMK-ava | AK | LLVLLCTFT | AT | —NH$_2$ | 6 | 0 | + | N |
| 410  | Ac—     | LRMK-ava | AV | GKEFNKLER | RM | —NH$_2$ | 4 | 1 |   | Y |
| 527  | Ac—     | LRMK-ava | GV | YQILAIYST | VASSL | —NH$_2$ | 5 | 1 |   | Y |
| 55   | Ac—     | LRMK-ava | SH | NGKLCLLKG | IA | —NH$_2$ | 4 | 1 | + | Y |
| 197  | Ac—     | LRMK-ava | VH | HPPNIGDQR | AL | —NH$_2$ | 2 | 2 |   | Y |
| 459  | Ac—     | LRMK-ava | NV | KNLYEKVKS | QL | —NH$_2$ | 4 | 2 |   | Y |
| 204  | Ac—     | LRMK-ava | GD | QRALYHTEN | AY | —NH$_2$ | 1 | 2 |   | Y |
| 128  | Ac—     | LRMK-ava | SS | FERFEIFPK | ES | —NH$_2$ | 4 | 0 |   | N |
| 122  | Ac—     | LRMK-ava | EQ | LSSVSSFER | FE | —NH$_2$ | 4 | 1 |   | Y |
| 3    | Ac—     | LRMK-ava | MK | AKLLVLLCT | FT | —NH$_2$ | 7 | 0 | + | N |
| 440  | Ac—     | LRMK-ava | NA | ELLVLLENE | RT | —NH$_2$ | 5 | 2 |   | N |
| 530  | Ac—     | LRMK-ava | QI | LAIYSTVAS | SL | —NH$_2$ | 5 | 1 |   | N |
| 266  | Ac—     | LRMK-ava | LI | APWYAFALS | RG | —NH$_2$ | 4 | 0 |   | Y |
| 171  | Ac—     | LRMK-ava | GK | NGLYPNLSK | SY | —NH$_2$ | 2 | 2 |   | Y |
| 240  | Ac—     | LRMK-ava | DQ | EGRINYYWT | LL | —NH$_2$ | 3 | 2 |   | Y |
| 142  | Ac—     | LRMK-ava | WP | NHTVTGVSA | SC | —NH$_2$ | 2 | 1 | + | Y |
| 253  | Ac—     | LRMK-ava | EP | GDTIIFEAN | GN | —NH$_2$ | 3 | 2 |   | Y |
| 334  | Ac—     | LRMK-ava | TG | LRNIPSIQS | RG | —NH$_2$ | 3 | 2 |   | Y |
| 112  | Ac—     | LRMK-ava | GY | FADYEELRE | QL | —NH$_2$ | 3 | 0 |   | Y |
| 521  | Ac—     | LRMK-ava | VK | LESMGVYQI | LA | —NH$_2$ | 6 | 1 |   | N |
| 395  | Ac—     | LRMK-ava | NK | VNSVIEKMN | TQ | —NH$_2$ | 4 | 4 |   | Y |
| 46   | Ac—     | LRMK-ava | TH | SVNLLEDSH | NG | —NH$_2$ | 3 | 2 |   | Y |
| 47   | Ac—     | LRMK-ava | HS | VNLLEDSHN | GK | —NH$_2$ | 3 | 2 |   | N |
| 158  | Ac—     | LRMK-ava | GK | SSFYRNLLW | LT | —NH$_2$ | 4 | 1 |   | Y |
| 6    | Ac—     | LRMK-ava | KL | LVLLCTFTA | TY | —NH$_2$ | 6 | 0 | + | N |

TABLE 30.H1.4

Ii-Key/H1 MHC class II epitope hybrids peptides for synthesis

| AEHA | N-term | N-term Spacer | f-N | Epitope | f-C | C-term | SEQ ID NO |
|---|---|---|---|---|---|---|---|
| 75 | Ac— | LRMK-ava | SV | AGWILGNPE | CE | —NH$_2$ | 1211 |
| 131 | Ac— | LRMK-ava | SSFER | FEIFPKESS | WP | —NH$_2$ | 1212 |
| 403 | Ac— | LRMK-ava | KM | NTQFTAVGK | EF | —NH$_2$ | 1214 |
| 262 | Ac— | LRMK-ava | AN | GNLIAPWYA | FA | —NH$_2$ | 1215 |
| 162 | Ac— | LRMK-ava | FY | RNLLWLTGK | NG | —NH$_2$ | 1217 |
| 428 | Ac— | LRMK-ava | KV | DDGFLDIWT | YN | —NH$_2$ | 1218 |
| 410 | Ac— | LRMK-ava | AV | GKEFNKLER | RM | —NH$_2$ | 1220 |
| 527 | Ac— | LRMK-ava | GV | YQILAIYST | VASSL | —NH$_2$ | 1221 |
| 55 | Ac— | LRMK-ava | SH | NGKLCLLKG | IA | —NH$_2$ | 1222 |
| 197 | Ac— | LRMK-ava | VH | HPPNIGDQR | AL | —NH$_2$ | 1223 |
| 459 | Ac— | LRMK-ava | NV | KNLYEKVKS | QL | —NH$_2$ | 1224 |
| 204 | Ac— | LRMK-ava | GD | QRALYHTEN | AY | —NH$_2$ | 1225 |
| 122 | Ac— | LRMK-ava | EQ | LSSVSSFER | FE | —NH$_2$ | 1227 |
| 266 | Ac— | LRMK-ava | LI | APWYAFALS | RG | —NH$_2$ | 1231 |
| 171 | Ac— | LRMK-ava | GK | NGLYPNLSK | SY | —NH$_2$ | 1232 |
| 240 | Ac— | LRMK-ava | DQ | EGRINYYWT | LL | —NH$_2$ | 1233 |
| 142 | Ac— | LRMK-ava | WP | NHTVTGVSA | SC | —NH$_2$ | 1234 |
| 253 | Ac— | LRMK-ava | EP | GDTIIFEAN | GN | —NH$_2$ | 1235 |
| 334 | Ac— | LRMK-ava | TG | LRNIPSIQS | RG | —NH$_2$ | 1236 |
| 112 | Ac— | LRMK-ava | GY | FADYEELRE | QL | —NH$_2$ | 1237 |
| 395 | Ac— | LRMK-ava | NK | VNSVIEKMN | TQ | —NH$_2$ | 1239 |
| 46 | Ac— | LRMK-ava | TH | SVNLLEDSH | NG | —NH$_2$ | 1240 |
| 158 | Ac— | LRMK-ava | GK | SSFYRNLLW | LT | —NH$_2$ | 1242 |

```
H3
Introduction:
LOCUS HMIVHA 566 aa linear VRL 16-JUL-1999
DEFINITION hemagglutinin precursor - influenza A virus
(strain A/Aichi/2/68).
ACCESSION HMIVHA
VERSION HMIVHA GI: 538597
DBSOURCE pir: locus HMIVHA;
REFERENCE 1 (residues 1 to 566)
AUTHORS Verhoeyen, M., Fang, R., Jou, W. M., Devos, R.,
Huylebroeck, D., Saman, E. and Fiers, W.
TITLE Antigenic drift between the haemagglutinin of the Hong Kong
influenza strains A/Aichi/2/68 and A/Victoria/3/75
JOURNAL Nature 286 (5775), 771-776 (1980)
MEDLINE 80254693
PUBMED 7402351
                                              (SEQ ID NO.: 1244)
  1mktiialsyi fclalgqdlp gndnstatlc lghhavpngt lyktitddqi evtnatelvq 61ssstgkicnn phrildgidc tlidallgdp hcdvfqnetw dlfverskaf sncypydvpd 121yaslrslvas sgtlefiteg ftwtgvtqng gsnackrgpg sgffsrlnwl tksgstypvl 181nvtmpnndnf dklyiwgihh pstnqeqtsl yvgasgrgtv strrsqqtii pnigsrpwvr
```

```
241glssrisiyw tivkpgdvlv insngnliap rgyfkmrtgk ssimrsdapi dtcisecitp

301ngsipndkpf qnvnkityga cpkyvkqntl klatgmrnvp ekqtrglfga iagfiengwe

361gmidgwygfr hqnsegtgqa adlkstqaai dqingklnrv iektnekfhq iekefseveg

421riqdlekyve dtkidlwsyn aellvalenq htidltdsem nklfektrrq lrenaeemgn

481gcfkiyhkcd naciesirng tydhdvyrde alnnrfqikg velksgykdw ilwisfaisc

541fllcvvllgf imwacqrgni rcnici
```

TABLE 30.H3.1

Rammensee algorithm-selected H3 MHC class II epitopes

| | 0101 | 0301 | 0401 | 0701 | 1101 | 1501 |
|---|---|---|---|---|---|---|
| 1 | 247 | 179 | 118 | 56 | 405 | 115 |
| 2 | 321 | 256 | 363 | 531 | 164 | 243 |
| 3 | 236 | 397 | 83 | 39 | 246 | 360 |
| 4 | 270 | 425 | 192 | 125 | 100 | 433 |
| 5 | 118 | 460 | 236 | 227 | 140 | 101 |
| 6 | 187 | 491 | 255 | 235 | 191 | 137 |
| 7 | 271 | 83 | 441 | 321 | 270 | 181 |
| 8 | 207 | 503 | 442 | 491 | 307 | 190 |
| 9 | 444 | 12 | 531 | 527 | 363 | 258 |
| 10 | 8 | 281 | 548 | 8 | 118 | 281 |
| 11 | 164 | 307 | 8 | 20 | 174 | 295 |
| 12 | 167 | 452 | 97 | 38 | 26 | 301 |
| 13 | 174 | 42 | 111 | 47 | 98 | 304 |
| 14 | 121 | 125 | 133 | 75 | 329 | 327 |
| 15 | 143 | 301 | 140 | 91 | 419 | 342 |
| 16 | 341 | 539 | 161 | 207 | 121 | 422 |
| 17 | 366 | 4 | 187 | 273 | 192 | 444 |
| 18 | 412 | 71 | 191 | 287 | 236 | 503 |
| 19 | 47 | 75 | 208 | 336 | 277 | 527 |
| 20 | 235 | 313 | 235 | 434 | 500 | 529 |
| 21 | 336 | 433 | 247 | 444 | 315 | 535 |
| 22 | 405 | 440 | 270 | 450 | 461 | 544 |
| 23 | 527 | 451 | 321 | 483 | 528 | 480 |
| 24 | 541 | 2 | 366 | 2 | 538 | 547 |
| 25 | 80 | 8 | 405 | 4 | 111 | 1 |
| 26 | 107 | 64 | 412 | 55 | 215 | 2 |
| 27 | 111 | 91 | 425 | 71 | 247 | 4 |
| 28 | 226 | 99 | 436 | 72 | 412 | 10 |
| 29 | 257 | 182 | 483 | 93 | 425 | 33 |
| 30 | 273 | 258 | 527 | 99 | 480 | 49 |
| 31 | 344 | 336 | 4 | 118 | 515 | 125 |
| 32 | 345 | 358 | 16 | 123 | 547 | 171 |
| 33 | 433 | 441 | 38 | 167 | 35 | 184 |
| 34 | 539 | 47 | 39 | 209 | 232 | 209 |
| 35 | 550 | 49 | 42 | 239 | 345 | 230 |
| 36 | 39 | 84 | 49 | 249 | 524 | 239 |
| 37 | 56 | 100 | 55 | 255 | 52 | 244 |
| 38 | 72 | 209 | 56 | 256 | 64 | 249 |
| 39 | 91 | 333 | 64 | 257 | 161 | 250 |
| 40 | 99 | 418 | 72 | 293 | 187 | 265 |
| 41 | 125 | 444 | 91 | 344 | 271 | 267 |
| 42 | 278 | 468 | 99 | 352 | 356 | 348 |
| 43 | 377 | 475 | 115 | 356 | 460 | 353 |
| 44 | 387 | 520 | 131 | 390 | 77 | 402 |
| 45 | 531 | 531 | 164 | 398 | 148 | 409 |
| 46 | 4 | 41 | 176 | 426 | 214 | 431 |
| 47 | 115 | 92 | 181 | 452 | 391 | 509 |
| 48 | 214 | 160 | 207 | 495 | 395 | 543 |
| 49 | 220 | 215 | 209 | 49 | 479 | 16 |
| 50 | 227 | 263 | 215 | 103 | 25 | 38 |

TABLE 30.H3.2

Highest ranking H3 MHC class II epitopes

| | 0101 | 0301 | 0401 | 0701 | 1101 | 1501 |
|---|---|---|---|---|---|---|
| 247 | 1 | | 21 | | 27 | +2 |
| 179 | | 1 | | +2 | | +2 |
| 118 | 5 | | 1 | 31 | 10 | |
| 56 | 37 | | 38 | 1 | | |
| 405 | 22 | | 25 | | 1 | |
| 115 | 47 | | 43 | | | 1 |
| 321 | 2 | | 23 | 7 | | |
| 256 | | +1 | 2 | −1 | 38 | +2 |
| 363 | | | 2 | | 9 | |
| 531 | 45 | 45 | 9 | | 2 | −2 |
| 164 | 11 | | 45 | | 2 | |
| 243 | | | | | | 2 |
| 236 | 3 | | 5 | | −1 | 18 |
| 397 | | 3 | | | +1 | −2 |
| 83 | | 7 | 3 | | | |
| 39 | 36 | | +2 | 34 | 3 | −1 |
| 246 | | +1 | | +1 | 3 | −2 |
| 360 | | | −2 | | | 3 |
| 270 | 4 | | 22 | | 7 | |
| 425 | | 4 | 27 | | +1 | 29 |
| 192 | | | 4 | | 17 | −2 |
| 125 | 41 | 14 | | 4 | | 31 |
| 100 | | −1 | 37 | −1 | −1 | 4 | +1 |
| 433 | 33 | | 21 | | +1 | 4 |
| 460 | | 5 | | | 43 | |
| 227 | 50 | | | 5 | | |
| 140 | | | 15 | | | 5 |

TABLE 30.H3.2-continued

Highest ranking H3 MHC class II epitopes

| | 0101 | 0301 | 0401 | 0701 | 1101 | 1501 |
|---|---|---|---|---|---|---|
| 101 | | −2 | −1 | −2 | +2 | −1 | 5 |
| 187 | 6 | | 17 | | 40 | |
| 491 | | 6 | | 8 | | |
| 255 | +2 | +1 | 6 | 37 | | |
| 235 | 20 | | 20 | 6 | +1 | |
| 191 | | | 18 | | 6 | −1 |
| 137 | | | | | | 6 |
| 8 | 10 | 25 | 11 | 10 | | |
| 4 | 46 | 17 | 31 | 25 | | 27 |

TABLE 30.H3.3

Proposed Ii-Key/H3 MHC class II epitope hybrid peptides peptides (SEQ ID NOS: 1245-1278, respectively, in order of appearance.)

| AEHA | N-term | Spacer | f-N | Epitope | f-C | C-term | LIVFM | NQ | C | Syn |
|---|---|---|---|---|---|---|---|---|---|---|
| 247 | Ac— | LRMK-ava | SRI | SIYWTIVKP | GD | —NH₂ | 4 | 0 | | Y |
| 179 | Ac— | LRMK-ava | YP | VLNVTMPNN | DN | —NH₂ | 4 | 4 | | Y |
| 118 | Ac— | LRMK-ava | CYPYD | VPDYASLRS | LV | —NH₂ | 4 | 0 | | Y |
| 56 | Ac— | LRMK-ava | NA | TELVQSSST | GK | —NH₂ | 2 | 2 | | Y |
| 405 | Ac— | LRMK-ava | KT | NEKFHQIEK | EF | —NH₂ | 3 | 2 | | Y |
| 115 | Ac— | LRMK-ava | CY | PYDVPDYAS | LR | —NH₂ | 2 | 0 | + | N |
| 321 | Ac— | LRMK-ava | GA | CPKYVKQNT | LK | —NH₂ | 2 | 2 | + | Y |
| 256 | Ac— | LRMK-ava | VKP | GDVLVINSN | GN | —NH₂ | 4 | 3 | | Y |
| 363 | Ac— | LRMK-ava | GWEGM | IDGWYGFRH | QN | —NH₂ | 3 | 2 | | Y |
| 531 | Ac— | LRMK-ava | DW | ILWISFAIS | CF | —NH₂ | 6 | 0 | + | N |
| 164 | Ac— | LRMK-ava | GF | FSRLNWLTK | SG | —NH₂ | 4 | 1 | | Y |
| 243 | Ac— | LRMK-ava | GL | SSRISIYWT | IV | —NH₂ | 5 | 0 | | N |
| 236 | Ac— | LRMK-ava | IGS | RPWVRGLSS | RI | —NH₂ | 3 | 0 | | Y |
| 397 | Ac— | LRMK-ava | GK | LNRVIEKTN | EK | —NH₂ | 3 | 2 | | Y |
| 83 | Ac— | LRMK-ava | TL | IDALLGDPH | CD | —NH₂ | 4 | 0 | + | Y |
| 39 | Ac— | LRMK-ava | PN | GTLVKTITD | DQ | —NH₂ | 3 | 2 | | Y |
| 246 | Ac— | LRMK-ava | SR | ISIYWTIVK | PG | —NH₂ | 4 | 0 | | N |
| 360 | Ac— | LRMK-ava | GW | EGMIDGWYG | FR | —NH₂ | 3 | 0 | | N |
| 270 | Ac— | LRMK-ava | IA | PRGYFKMRT | GK | —NH₂ | 3 | 0 | | Y |
| 425 | Ac— | LRMK-ava | QD | LEKYVEDTK | ID | —NH₂ | 3 | 1 | | Y |
| 192 | Ac— | LRMK-ava | NFD | KLYIWGIHH | PS | —NH₂ | 4 | 0 | | Y |
| 125 | Ac— | LRMK-ava | SL | RSLVASSGT | LE | —NH₂ | 4 | 0 | | Y |
| 100 | Ac— | LRMK-ava | ET | WDLFVERSK | AFS | —NH₂ | 4 | 0 | | Y |
| 433 | Ac— | LRMK-ava | DT | KIDLWSYNA | EL | —NH₂ | 3 | 1 | | Y |
| 460 | Ac— | LRMK-ava | SE | MNKLFEKTR | RQ | —NH₂ | 3 | 1 | | Y |
| 227 | Ac— | LRMK-ava | SQ | QTIIPNIGS | RP | —NH₂ | 3 | 3 | | Y |
| 140 | Ac— | LRMK-ava | TE | GFTWTGVTQ | NG | —NH₂ | 2 | 2 | | Y |
| 101 | Ac— | LRMK-ava | TW | DLFVERSKA | FS | —NH₂ | 3 | 0 | | N |

TABLE 30.H3.3-continued

Proposed Ii-Key/H3 MHC class II epitope hybrid peptides peptides (SEQ ID NOS: 1245-1278, respectively, in order of appearance.)

| AEHA | N-term | Spacer | f-N | Epitope | f-C | C-term | LIVFM | NQ | C | Syn |
|---|---|---|---|---|---|---|---|---|---|---|
| 187 | Ac— | LRMK-ava | PN | NDNFDKLYI | WG | —NH₂ | 3 | 3 | | Y |
| 491 | Ac— | LRMK-ava | CD | NACIESIRN | GT | —NH₂ | 2 | 2 | + | Y |
| 255 | Ac— | LRMK-ava | VK | PGDVLVINS | NG | —NH₂ | 5 | 2 | | N |
| 235 | Ac— | LRMK-ava | IG | SRPWVRGLS | SR | —NH₂ | 2 | 0 | | N |
| 191 | Ac— | LRMK-ava | NF | DKLYIWGIH | HP | —NH₂ | 4 | 1 | | N |
| 137 | Ac— | LRMK-ava | EF | ITEGFTWTG | VT | —NH₂ | 4 | 0 | | Y |

TABLE 30.H3.4

Ii-Key/H3 MHC class II epitope hybrids peptides for synthesis

| AEHA | N-term | Spacer | f-N | Epitope | C-f-C term | SEQ ID NO |
|---|---|---|---|---|---|---|
| 247 | Ac— | LRMK-ava | SRI | SIYWTIVKP | GD —NH₂ | 1245 |
| 179 | Ac— | LRMK-ava | YP | VLNVTMPNN | DN —NH₂ | 1246 |
| 118 | Ac— | LRMK-ava | CYPYD | VPDYASLRS | LV —NH₂ | 1247 |
| 56 | Ac— | LRMK-ava | NA | TELVQSSST | GK —NH₂ | 1248 |
| 405 | Ac— | LRMK-ava | KT | NEKFHQIEK | EF —NH₂ | 1249 |
| 321 | Ac— | LRMK-ava | GA | CPKYVKQNT | LK —NH₂ | 1251 |
| 256 | Ac— | LRMK-ava | VKP | GDVLVINSN | GN —NH₂ | 1252 |
| 363 | Ac— | LRMK-ava | GWEGM | IDGWYGFRH | QN —NH₂ | 1253 |
| 164 | Ac— | LRMK-ava | GF | FSRLNWLTK | SG —NH₂ | 1255 |
| 236 | Ac— | LRMK-ava | IGS | RPWVRGLSS | RI —NH₂ | 1257 |
| 397 | Ac— | LRMK-ava | GK | LNRVIEKTN | EK —NH₂ | 1258 |
| 83 | Ac— | LRMK-ava | TL | IDALLGDPH | CD —NH₂ | 1259 |
| 39 | Ac— | LRMK-ava | PN | GTLVKTITD | DQ —NH₂ | 1260 |
| 270 | Ac— | LRMK-ava | IA | PRGYFKMRT | GK —NH₂ | 1263 |
| 425 | Ac— | LRMK-ava | QD | LEKYVEDTK | ID —NH₂ | 1264 |
| 192 | Ac— | LRMK-ava | NFD | KLYIWGIHH | PS —NH₂ | 1265 |
| 125 | Ac— | LRMK-ava | SL | RSLVASSGT | LE —NH₂ | 1266 |
| 100 | Ac— | LRMK-ava | ET | WDLFVERSK | AFS —NH₂ | 1267 |
| 433 | Ac— | LRMK-ava | DT | KIDLWSYNA | EL —NH₂ | 1268 |
| 460 | Ac— | LRMK-ava | SE | MNKLFEKTR | RQ —NH₂ | 1269 |
| 227 | Ac— | LRMK-ava | SQ | QTIIPNIGS | RP —NH₂ | 1270 |
| 140 | Ac— | LRMK-ava | TE | GFTWTGVTQ | NG —NH₂ | 1271 |
| 187 | Ac— | LRMK-ava | PN | NDNFDKLYI | WG —NH₂ | 1273 |
| 491 | Ac— | LRMK-ava | CD | NACIESIRN | GT —NH₂ | 1274 |
| 137 | Ac— | LRMK-ava | EF | ITEGFTWTG | VT —NH₂ | 1278 |

H7
Introduction:
LOCUS AAT78582 567 aa linear VRL 14-DEC-2004
DEFINITION hemagglutinin
[Influenza A virus (A/chicken/British
Columbia/GSC_human_B/04(H7N3))].
ACCESSION AAT78582
VERSION AAT78582.1 GI: 50542636
DBSOURCE accession AY646078.1
REFERENCE 1 (residues 1 to 567)
AUTHORS Hirst, M., Astell, C. R., Griffith, M., Coughlin, S. M.,
Moksa, M., Zeng, T., Smailus, D. E., Holt, R. A., Jones, S.,
Marra, M. A., Petric, M., Krajden, M., Lawrence, D., Mak, A.,
Chow, R., Skowronski, D. M., Tweed, A., Goh, W., Brunham,
R. C., Robinson, J., Bowes, V., Sojonky, K., Byrne, S. K., Li,
Y., Kobasa, D., Booth, T. and Paetzel, M.
TITLE Novel Avian Influenza H7N3 Strain Outbreak, British Columbia
JOURNAL Emerging Infect. Dis. 10 (12), 2192-2195 (2004)
(SEQ ID NO.: 1279)
1 mntqilafia cmligtkgdk iclghhavan gtkvntlter gievvnatet vetvnikkic 61 tqgkrptdlg qcgllgtlig ppqcdqflef danliierre gtdvcypgkf tneeslrqil -continued

```
121 rgsggidkes mgftysgirt ngatsacrrs gssfyaemkw llsnsdnaaf pqmtksyrnp
181 rnkpaliiwg vhhsgsateq tklygsgnkl itvgsskyqq sftpspgarp qvngqsgrid
241 fhwllldpnd tvtftfngaf iapdrasffr geslgvqsdv pldsgcegdc fhsggtivss
301 lpfqninprt vgkcpryvkq tslllatgmr nvpenpkqay qkrmtrglfg aiagfiengw
361 eglidgwygf rhqnaqgegt aadykstqsa idqitgklnr lidktnqqfe lidnefseie
421 qqignvinwt rdsmtevwsy naellvamen qhtidladse mnklyervrk qlrenaeedg
481 tgcfeifhkc ddqcmesirn ntydhtqyrt eslqnriqid pvklssgykd iilwfsfgas
541 cflllaiamg lvficikngn mrctici
```

TABLE 30.H7.1

Rammensee algorithm-selected H7 MHC class II epitopes

| | 0101 | 0301 | 0401 | 0701 | 1101 | 1501 |
|---|---|---|---|---|---|---|
|

TABLE 30.H7.2-continued

| Highest ranking H7 MHC class II epitopes | | | | | | |
|---|---|---|---|---|---|---|
| | 0101 | 0301 | 0401 | 0701 | 1101 | 1501 |
| 251 | 5 | | −2 | | −2 | 21 | 21 |
| 159 | | −2 | 5 | −2 | 6 | −2 | |
| 249 | | +2 | 6 | | 5 | +2 | +2 |
| 84 | 19 | | +1 | 14 | +1 | | 5 |
| 337 | 6 | | | | 9 | +1 | |
| 53 | 24 | | 6 | | 25 | | 50 |
| 152 | 37 | | −1 | −1 | | 6 | |
| 42 | | | −1 | 36 | 14 | | 6 |

TABLE 30.H7.3

Proposed Ii-Key/H7 MHC class II epitope hybrid peptides peptides
(SEQ ID NOS: 1280-1309, respectively, in order of appearance.)

| AEHA | N-term | Spacer | f-N | Epitope | f-C | C-term | LIVFM | NQ | C | Syn |
|---|---|---|---|---|---|---|---|---|---|---|
| 314 | Ac— | LRMK-ava | GK | CPRYVKQTS | LL | —NH$_2$ | 3 | 1 | + | Y |
| 241 | Ac— | LRMK-ava | ID | FHWLLLDPN | DT | —NH$_2$ | 5 | 1 | | N |
| 107 | Ac— | LRMK-ava | CY | PGKFTNEES | LR | —NH$_2$ | 2 | 1 | + | Y |
| 550 | Ac— | LRMK-ava | AM | GLVFICIKN | GN | —NH$_2$ | 6 | 2 | + | N |
| 113 | Ac— | LRMK-ava | TN | EESLRQILR | GS | —NH$_2$ | 3 | 2 | | Y |
| 361 | Ac— | LRMK-ava | GW | EGLIDGWYG | FR | —NH$_2$ | 3 | 0 | | Y |
| 132 | Ac— | LRMK-ava | SM | GFTYSGIRT | NG | —NH$_2$ | 3 | 1 | | Y |
| 258 | Ac— | LRMK-ava | FN | GAFIAPDRA | SF | —NH$_2$ | 4 | 1 | | Y |
| 185 | Ac— | LRMK-ava | KP | ALIIWGVHH | SG | —NH$_2$ | 4 | 0 | | Y |
| 528 | Ac— | LRMK-ava | SG | YKDIILWFS | FG | —NH$_2$ | 5 | 0 | | N |
| 300 | Ac— | LRMK-ava | VS | SLPFQNINP | RT | —NH$_2$ | 4 | 3 | | Y |
| 329 | Ac— | LRMK-ava | TG | MRNVPENPK | QA | —NH$_2$ | 2 | 3 | | Y |
| 364 | Ac— | LRMK-ava | GL | IDGWYGFRH | QN | —NH$_2$ | 3 | 2 | | N |
| 157 | Ac— | LRMK-ava | YA | EMKWLLSNS | DN | —NH$_2$ | 3 | 2 | | Y |
| 462 | Ac— | LRMK-ava | EM | NKLYERVRK | QL | —NH$_2$ | 4 | 2 | | Y |
| 2 | Ac— | LRMK-ava | M | NTQILAFIA | CM | —NH$_2$ | 5 | 1 | + | N |
| 416 | Ac— | LRMK-ava | NE | FSEIEQQIG | NV | —NH$_2$ | 4 | 4 | | Y |
| 85 | Ac— | LRMK-ava | QC | DQFLEFDAN | LI | —NH$_2$ | 5 | 3 | + | N |
| 406 | Ac— | LRMK-ava | KT | NQQFELIDN | EF | —NH$_2$ | 4 | 4 | | Y |
| 200 | Ac— | LRMK-ava | TE | QTKLYGSGN | KL | —NH$_2$ | 2 | 2 | | Y |
| 167 | Ac— | LRMK-ava | SD | NAAFPQMTK | SY | —NH$_2$ | 2 | 2 | | Y |
| 434 | Ac— | LRMK-ava | DS | MTEVWSYNA | EL | —NH$_2$ | 3 | 1 | | Y |
| 251 | Ac— | LRMK-ava | ND | TVTFTFNGA | FI | —NH$_2$ | 5 | 2 | | N |
| 159 | Ac— | LRMK-ava | EM | KWLLSNSDN | AA | —NH$_2$ | 3 | 2 | | N |
| 249 | Ac— | LRMK-ava | DP | NDTVTFTFN | GA | —NH$_2$ | 3 | 2 | | Y |
| 84 | Ac— | LRMK-ava | PQ | CDQFLEFDA | NL | —NH$_2$ | 3 | 3 | + | Y |
| 337 | Ac— | LRMK-ava | NP | KQAYQKRMT | RG | —NH$_2$ | 1 | 3 | | Y |
| 53 | Ac— | LRMK-ava | VE | TVNIKKICT | QG | —NH$_2$ | 4 | 2 | + | Y |

TABLE 30.H7.3-continued

Proposed Ii-Key/H7 MHC class II epitope hybrid peptides peptides
(SEQ ID NOS: 1280-1309, respectively, in order of appearance.)

| AEHA | N-term | Spacer | f-N | Epitope | f-C | C-term | LIVFM | NQ | C Syn |
|------|--------|--------|-----|---------|-----|--------|-------|----|----|
| 152 | Ac— | LRMK-ava | SG | SSFYAEMKW | LL | —NH$_2$ | 4 | 0 | Y |
| 42 | Ac— | LRMK-ava | RG | IEVVNATET | VE | —NH$_2$ | 4 | 1 | Y |

TABLE 30.H7.4

Ii-Key/H7 MHC class II epitope hybrids peptides for synthesis

| AEHA | N-term | Spacer | f-N | Epitope | f-C | C-term | SEQ ID NO |
|------|--------|--------|-----|---------|-----|--------|-----------|
| 314 | Ac— | LRMK-ava | GK | CPRYVKQTS | LL | —NH$_2$ | 1280 |
| 107 | Ac— | LRMK-ava | CY | PGKFTNEES | LR | —NH$_2$ | 1282 |
| 113 | Ac— | LRMK-ava | TN | EESLRQILR | GS | —NH$_2$ | 1284 |
| 361 | Ac— | LRMK-ava | GW | EGLIDGWYG | FRHQN | —NH$_2$ | 1310 |
| 132 | Ac— | LRMK-ava | SM | GFTYSGIRT | NG | —NH$_2$ | 1286 |
| 258 | Ac— | LRMK-ava | FN | GAFIAPDRA | SF | —NH$_2$ | 1287 |
| 185 | Ac— | LRMK-ava | KP | ALIIWGVHH | SG | —NH$_2$ | 1288 |
| 300 | Ac— | LRMK-ava | VS | SLPFQNINP | RT | —NH$_2$ | 1290 |
| 329 | Ac— | LRMK-ava | TG | MRNVPENPK | QA | —NH$_2$ | 1291 |
| 157 | Ac— | LRMK-ava | YA | EMKWLLSNS | DNAA | —NH$_2$ | 1311 |
| 462 | Ac— | LRMK-ava | EM | NKLYERVRK | QL | —NH$_2$ | 1294 |
| 416 | Ac— | LRMK-ava | NE | FSEIEQQIG | NV | —NH$_2$ | 1296 |
| 406 | Ac— | LRMK-ava | KT | NQQFELIDN | EF | —NH$_2$ | 1298 |
| 200 | Ac— | LRMK-ava | TE | QTKLYGSGN | KL | —NH$_2$ | 1299 |
| 167 | Ac— | LRMK-ava | SD | NAAFPQMTK | SY | —NH$_2$ | 1300 |
| 434 | Ac— | LRMK-ava | DS | MTEVWSYNA | EL | —NH$_2$ | 1301 |
| 249 | Ac— | LRMK-ava | DP | NDTVTFTFN | GA | —NH$_2$ | 1304 |
| 84 | Ac— | LRMK-ava | PQ | CDQFLEFDA | NL | —NH$_2$ | 1305 |
| 337 | Ac— | LRMK-ava | NP | KQAYQKRMT | RG | —NH$_2$ | 1306 |
| 53 | Ac— | LRMK-ava | VE | TVNIKKICT | QG | —NH$_2$ | 1307 |
| 152 | Ac— | LRMK-ava | SG | SSFYAEMKW | LL | —NH$_2$ | 1308 |
| 42 | Ac— | LRMK-ava | RG | IEVVNATET | VE | —NH$_2$ | 1309 |

```
H9
Introduction:
LOCUS INA404627 1714 bp RNA linear VRL 18-AUG-2000
DEFINITION Influenza A virus ha gene for Hemagglutinin,
genomic RNA, strain A/Hong Kong/1074/99(H9N2).
ACCESSION AJ404627
VERSION AJ404627.1 GI: 8894695
REFERENCE 1
AUTHORS Lin, Y. P., Shaw, M., Gregory, V., Cameron, K., Lim,
W., Klimov, A., Subbarao, K., Guan, Y., Krauss, S., Shortridge,
K., Webster, R., Cox, N. and Hay, A.
TITLE Avian-to-human transmission of H9N2 subtype
influenza A viruses: relationship between H9N2 and
H5N1 human isolates
JOURNAL Proc. Natl. Acad. Sci. U.S.A. 97 (17), 9654-9658 (2000)
MEDLINE 20402590
PUBMED 10920197
```

(SEQ ID NO.: 1312)

METISLITILLVVTASNADKICIGHQSTNSTETVDTLTETNVPV

THAKELLHTEHNGMLCATSLGHPLILDTCTIEGLVYGNPSCDLLLEGREWSYIVERSS

AVNGTCYPGNVENLEELRTLFSSASSYQRIQIFPDTTWNVTYTGTSRACSGSFYRSMR

WLTQKSGFYPVQDAQYTNNRGKSILFVWGIHHPPTYTEQTNLYIRNDTTTSVTTEDLN

RTFKPVIGPRPLVNGLQGRIDYYWSVLKPGQTLRVRSNGNLIAPWYGHVLSGGSHGRI

LKTDLKSGNCVVQCQTEKGGLNSTLPFHNISKYAFGTCPKYVRVNSLKLAVGLRNVPA

RSSRGLFGAIAGFIEGGWPGLVAGWYGFQHSNDQGVGMAADRDSTQKAIDKITSKVNN

IVDKMNKQYEIIDHEFSEVETRLNMINNKIDDQIQDVWAYNAELLVLLENQKTLDEHD

```
ANVNNLYNKVKRALGSNAMEDGKGCFELYHKCDDQCMETIRNGTYNRRKYREESRLER

QKIEGVKLESEGAYKILTIYSTVASSLVLAMGFAAFLFWAMSNGSCRCNICI
```

TABLE 30.H9.1

Rammensee algorithm-selected H9 MHC class II epitopes

| | 0101 | 0301 | 0401 | 0701 | 1101 | 1501 |
|---|---|---|---|---|---|---|
| 1 | 218 | 274 | 93 | 359 | 454 | 235 |
| 2 | 326 | 511 | 261 | 139 | 398 | 353 |
| 3 | 116 | 85 | 314 | 93 | 141 | 522 |
| 4 | 261 | 210 | 398 | 137 | 91 | 257 |
| 5 | 314 | 248 | 405 | 314 | 183 | 426 |
| 6 | 7 | 435 | 525 | 484 | 218 | 55 |
| 7 | 113 | 465 | 6 | 521 | 238 | 66 |
| 8 | 423 | 390 | 9 | 525 | 300 | 95 |
| 9 | 525 | 453 | 48 | 8 | 261 | 113 |
| 10 | 521 | 48 | 84 | 39 | 322 | 159 |
| 11 | 4 | 300 | 113 | 47 | 4 | 181 |
| 12 | 173 | 484 | 116 | 66 | 72 | 182 |
| 13 | 510 | 533 | 131 | 76 | 84 | 215 |
| 14 | 398 | 65 | 184 | 120 | 92 | 221 |
| 15 | 10 | 131 | 201 | 131 | 184 | 242 |
| 16 | 53 | 201 | 380 | 158 | 377 | 250 |
| 17 | 228 | 434 | 434 | 193 | 391 | 294 |
| 18 | 334 | 41 | 435 | 201 | 7 | 297 |
| 19 | 349 | 84 | 450 | 214 | 152 | 303 |
| 20 | 505 | 241 | 521 | 242 | 308 | 320 |
| 21 | 513 | 250 | 542 | 329 | 317 | 335 |
| 22 | 522 | 369 | 91 | 427 | 326 | 346 |
| 23 | 532 | 433 | 120 | 476 | 521 | 408 |
| 24 | 31 | 436 | 137 | 524 | 113 | 532 |
| 25 | 39 | 534 | 141 | 1 | 116 | 540 |
| 26 | 64 | 9 | 152 | 10 | 156 | 538 |

TABLE 30.H9.1-continued

Rammensee algorithm-selected H9 MHC class II epitopes

| | 0101 | 0301 | 0401 | 0701 | 1101 | 1501 |
|---|---|---|---|---|---|---|
| 27 | 91 | 76 | 193 | 31 | 237 | 541 |
| 28 | 137 | 112 | 200 | 48 | 246 | 1 |
| 29 | 159 | 257 | 238 | 55 | 260 | 3 |
| 30 | 193 | 298 | 239 | 68 | 349 | 4 |
| 31 | 200 | 329 | 356 | 91 | 356 | 41 |
| 32 | 201 | 344 | 357 | 119 | 405 | 61 |
| 33 | 329 | 383 | 429 | 165 | 423 | 110 |
| 34 | 457 | 426 | 454 | 248 | 473 | 123 |
| 35 | 458 | 524 | 497 | 300 | 497 | 129 |
| 36 | 530 | 39 | 519 | 337 | 58 | 150 |
| 37 | 534 | 67 | 538 | 380 | 137 | 162 |
| 38 | 72 | 110 | 1 | 383 | 239 | 222 |
| 39 | 93 | 165 | 3 | 415 | 296 | 236 |
| 40 | 139 | 227 | 4 | 526 | 314 | 258 |
| 41 | 166 | 322 | 7 | 528 | 338 | |
| 42 | 239 | 444 | 18 | 542 | 453 | |
| 43 | 257 | 31 | 20 | 9 | 525 | |
| 44 | 300 | 156 | 31 | 41 | 126 | |
| 45 | 337 | 167 | 47 | 78 | 139 | |
| 46 | 338 | 191 | 55 | 85 | 153 | |
| 47 | 342 | 391 | 76 | 129 | 165 | |
| 48 | 405 | 399 | 110 | 133 | 200 | |
| 49 | 426 | 408 | 119 | 144 | 244 | |
| 50 | 503 | 412 | 139 | 231 | 265 | |

TABLE 30.H9.2

Highest ranking H9 MHC class II epitopes

TABLE 30.H9.3

Proposed Ii-Key/H9 MHC class II epitope hybrid peptides peptides (SEQ ID NOS: 1313-1342, respectively, in order of appearance.)

| AEHA | N-term | Spacer | f-N | Epitope | f-C | C-term | LIVFM | NQ | C | Syn |
|---|---|---|---|---|---|---|---|---|---|---|
| 218 | Ac— | LRMK-ava | DL | NRTFKPVIG | PR | —NH$_2$ | 4 | 1 | | Y |
| 274 | Ac— | LRMK-ava | SH | GRILKTDLK | SG | —NH$_2$ | 3 | 0 | | Y |
| 93 | Ac— | LRMK-ava | GR | EWSYIVERS | SA | —NH$_2$ | 2 | 0 | | Y |
| 359 | Ac— | LRMK-ava | AG | WYGFQHSND | QG | —NH$_2$ | 1 | 3 | | Y |
| 454 | Ac— | LRMK-ava | NV | NNLYNKVKR | AL | —NH$_2$ | 4 | 4 | | Y |
| 235 | Ac— | LRMK-ava | GL | QGRIDYYWS | VL | —NH$_2$ | 4 | 1 | | Y |
| 326 | Ac— | LRMK-ava | KL | AVGLRNVPA | RS | —NH$_2$ | 4 | 1 | | Y |
| 511 | Ac— | LRMK-ava | QK | IEGVKLESE | GA | —NH$_2$ | 3 | 1 | | Y |
| 261 | Ac— | LRMK-ava | LI | APWYGHVLS | GG | —NH$_2$ | 4 | 0 | | Y |
| 139 | Ac— | LRMK-ava | DT | TWNVTYTGT | SR | —NH$_2$ | 1 | 1 | | Y |
| 398 | Ac— | LRMK-ava | KM | NKQYEIIDH | EF | —NH$_2$ | 4 | 2 | | Y |
| 353 | Ac— | LRMK-ava | GW | PGLVAGWYG | FQ | —NH$_2$ | 3 | 1 | | Y |
| 116 | Ac— | LRMK-ava | EN | LEELRTLFS | SA | —NH$_2$ | 4 | 1 | | Y |
| 85 | Ac— | LRMK-ava | PS | CDLLLEGRE | WS | —NH$_2$ | 3 | 0 | + | Y |
| 314 | Ac— | LRMK-ava | GT | CPKYVRVNS | LK | —NH$_2$ | 3 | 1 | + | Y |
| 141 | Ac— | LRMK-ava | TW | NVTYTGTSR | AC | —NH$_2$ | 1 | 1 | + | N |
| 522 | Ac— | LRMK-ava | GA | YKILTIYST | VA | —NH$_2$ | 4 | 0 | | Y |
| 210 | Ac— | LRMK-ava | TT | TSVTTEDLN | RT | —NH$_2$ | 2 | 1 | | Y |
| 137 | Ac— | LRMK-ava | FP | DTTWNVTYT | GT | —NH$_2$ | 2 | 1 | | N |
| 91 | Ac— | LRMK-ava | LE | GREWSYIVE | RS | —NH$_2$ | 3 | 0 | | N |
| 257 | Ac— | LRMK-ava | SN | GNLIAPWYG | HV | —NH$_2$ | 3 | 2 | | Y |
| 248 | Ac— | LRMK-ava | KP | GQTLRVRSN | GN | —NH$_2$ | 2 | 3 | | Y |
| 405 | Ac— | LRMK-ava | II | DHEFSEVET | RL | —NH$_2$ | 5 | 0 | | N |
| 183 | Ac— | LRMK-ava | GK | SILFVWGIH | HP | —NH$_2$ | 5 | 0 | | N |
| 426 | Ac— | LRMK-ava | DQ | IQDVWAYNA | EL | —NH$_2$ | 3 | 2 | | Y |
| 7 | Ac— | LRMK-ava | SL | ITILLVVTA | SN | —NH$_2$ | 7 | 1 | | N |
| 435 | Ac— | LRMK-ava | NA | ELLVLLENQ | KT | —NH$_2$ | 5 | 3 | | N |
| 525 | Ac— | LRMK-ava | KI | LTIYSTVAS | SL | —NH$_2$ | 5 | 0 | | N |
| 484 | Ac— | LRMK-ava | CD | DQCMETIRN | GT | —NH$_2$ | 2 | 2 | + | Y |
| 55 | Ac— | LRMK-ava | TE | HNGMLCATS | LG | —NH$_2$ | 4 | 1 | + | Y |

TABLE 30.H9.4

Ii-Key/H9 MHC class II epitope hybrids peptides for synthesis

| AEHA | N-term | Spacer | f-N | Epitope | f-C | C-term | SEQ ID NO |
|---|---|---|---|---|---|---|---|
| 218 | Ac— | LRMK-ava | DL | NRTFKPVIG | PR | —NH$_2$ | 1313 |
| 274 | Ac— | LRMK-ava | SH | GRILKTDLK | SG | —NH$_2$ | 1314 |
| 93 | Ac— | LRMK-ava | GR | EWSYIVERS | SA | —NH$_2$ | 1315 |
| 359 | Ac— | LRMK-ava | AG | WYGFQHSND | QG | —NH$_2$ | 1316 |
| 454 | Ac— | LRMK-ava | NV | NNLYNKVKR | AL | —NH$_2$ | 1317 |
| 235 | Ac— | LRMK-ava | GL | QGRIDYYWS | VL | —NH$_2$ | 1318 |
| 326 | Ac— | LRMK-ava | KL | AVGLRNVPA | RS | —NH$_2$ | 1319 |
| 511 | Ac— | LRMK-ava | QK | IEGVKLESE | GA | —NH$_2$ | 1320 |
| 261 | Ac— | LRMK-ava | LI | APWYGHVLS | GG | —NH$_2$ | 1321 |
| 139 | Ac— | LRMK-ava | FPDT | TWNVTYTGT | SRAC | —NH$_2$ | 1343 |
| 398 | Ac— | LRMK-ava | KM | NKQYEIIDH | EF | —NH$_2$ | 1323 |
| 353 | Ac— | LRMK-ava | GW | PGLVAGWYG | FQ | —NH$_2$ | 1324 |
| 116 | Ac— | LRMK-ava | EN | LEELRTLFS | SA | —NH$_2$ | 1325 |
| 85 | Ac— | LRMK-ava | PS | CDLLLEGRE | WS | —NH$_2$ | 1326 |
| 314 | Ac— | LRMK-ava | GT | CPKYVRVNS | LK | —NH$_2$ | 1327 |
| 522 | Ac— | LRMK-ava | GA | YKILTIYST | VASSL | —NH$_2$ | 1344 |
| 210 | Ac— | LRMK-ava | TT | TSVTTEDLN | RT | —NH$_2$ | 1330 |
| 257 | Ac— | LRMK-ava | SN | GNLIAPWYG | HV | —NH$_2$ | 1333 |
| 248 | Ac— | LRMK-ava | KP | GQTLRVRSN | GN | —NH$_2$ | 1334 |
| 426 | Ac— | LRMK-ava | DQ | IQDVWAYNA | EL | —NH$_2$ | 1337 |
| 484 | Ac— | LRMK-ava | CD | DQCMETIRN | GT | —NH$_2$ | 1341 |
| 55 | Ac— | LRMK-ava | TE | HNGMLCATS | LG | —NH$_2$ | 1342 |

H2

Introduction:
LOCUS AAA64364 562 aa linear VRL 27-MAR-1995
DEFINITION hemagglutinin.

```
ACCESSION AAA64364
VERSION AAA64364.1 GI: 305155
DBSOURCE locus FLAHAJ3055 accession L20407.1
REFERENCE 1 (residues 1 to 562)
AUTHORS Connor, R. J., Kawaoka, Y., Webster, R. G. and
Paulson, J. C.
TITLE Receptor specificity in human, avian, and equine H2 and
H3 influenza virus isolates
JOURNAL Virology 205 (1), 17-23 (1994)
MEDLINE 95065649
PUBMED 7975212
                                         (SEQ ID NO.: 1345)
  1 maiiylillf tavrgdqici gyhannstek vdtilernvt vthakdilek thngklckln
 61 gipplelgdc siagwllgnp ecdrllsvpe wsyimekenp rdglcypgsf ndyeelkhll
121 ssvkhfekvk ilpkdrwtqh tttggsraca vsgnpsffrn mvwltkkgsd ypvakgsynn
181 tsgeqmliiw gvhhpndete qrtlyqnvgt yvsvgtstln krstpeiatr pkvngqggrm
241 efswtlldmw dtinfestgn liapeygfki skrgssgimk tegtlencet kcqtplgain
301 ttlpfhnvhp ltigecpkyv kseklvlatg lrnypqiesr glfgaiagfi eggwqgmvdg
361 wygyhhsndq gsgyaadkes tqkafdgitn kvnsviekmn tqfeavgkef snlerrlenl
421 nkkmedgfld vwtynaellv lmenertldf hdsnvknlyd kyrmqlrdnv kelgngcfef
481 yhkcddecmn svkngtydyp kyeeesklnr neikgvklss mgvyqilaiy atvagslsla
541 immagisfwm csngslqcri ci
```

TABLE 30.H2.1

Rammensee algorithm-selected H2 MHC class II epitopes

| | 0101 | 0301 | 0401 | 0701 | 1101 | 1501 |
|---|---|---|---|---|---|---|
| 1 | 53 | 82 | 110 | 45 | 110 | 4 |
| 2 | 7 | 437 | 202 | 331 | 400 | 205 |
| 3 | 536 | 467 | 208 | 530 | 158 | 524 |
| 4 | 208 | 392 | 382 | 28 | 407 | 120 |
| 5 | 331 | 486 | 425 | 252 | 265 | 244 |
| 6 | 527 | 45 | 6 | 175 | 202 | 518 |
| 7 | 202 | 417 | 113 | 208 | 463 | 107 |
| 8 | 523 | 455 | 117 | 36 | 527 | 355 |
| 9 | 2 | 545 | 250 | 216 | 126 | 428 |
| 10 | 302 | 10 | 276 | 239 | 264 | 85 |
| 11 | 425 | 308 | 328 | 250 | 425 | 32 |
| 12 | 520 | 513 | 331 | 267 | 324 | 53 |
| 13 | 56 | 56 | 2 | 316 | 50 | 56 |
| 14 | 293 | 120 | 7 | 323 | 89 | 69 |
| 15 | 158 | 129 | 19 | 429 | 117 | 148 |
| 16 | 175 | 244 | 88 | 447 | 186 | 183 |
| 17 | 267 | 250 | 123 | 478 | 224 | 184 |
| 18 | 320 | 459 | 168 | 526 | 272 | 199 |
| 19 | 512 | 462 | 241 | 539 | 414 | 246 |
| 20 | 36 | 73 | 247 | 545 | 293 | 259 |
| 21 | 110 | 74 | 252 | 56 | 316 | 276 |
| 22 | 161 | 116 | 265 | 88 | 523 | 296 |
| 23 | 336 | 128 | 302 | 103 | 536 | 299 |
| 24 | 467 | 224 | 359 | 237 | 1 | 322 |
| 25 | 183 | 331 | 371 | 244 | 7 | 337 |
| 26 | 201 | 353 | 400 | 246 | 53 | 379 |
| 27 | 216 | 410 | 407 | 293 | 122 | 397 |
| 28 | 230 | 428 | 431 | 339 | 134 | 404 |
| 29 | 259 | 435 | 521 | 351 | 155 | 520 |
| 30 | 400 | 436 | 527 | 361 | 241 | 530 |
| 31 | 459 | 438 | 545 | 382 | 263 | 539 |
| 32 | 250 | 439 | 1 | 385 | 328 | 543 |
| 34 | 328 | 446 | 3 | 425 | 351 | 547 |
| 35 | 339 | 461 | 15 | 427 | 358 | 252 |
| 36 | 340 | 28 | 17 | 437 | 475 | 302 |
| 37 | 428 | 91 | 28 | 439 | 499 | 1 |
| 38 | 507 | 126 | 45 | 528 | 520 | 101 |
| 39 | 526 | 159 | 56 | 38 | 6 | 117 |
| 40 | 1 | 300 | 120 | 82 | 29 | 152 |
| 41 | 3 | 310 | 158 | 176 | 252 | 224 |
| 42 | 28 | 324 | 185 | 292 | 340 | 237 |
| 43 | 113 | 328 | 186 | 343 | 382 | 238 |
| 44 | 244 | 363 | 205 | 392 | 456 | 317 |
| 45 | 287 | 463 | 209 | 417 | 2 | 328 |
| 46 | 510 | 470 | 246 | 467 | 88 | 334 |
| 47 | 515 | 526 | 259 | 486 | 116 | 343 |
| 48 | 537 | 17 | 282 | 513 | 123 | 348 |
| 49 | 66 | 93 | 293 | 538 | 139 | 422 |
| 50 | 145 | 106 | 317 | 1 | 185 | 426 |

TABLE 30.H2.2

Highest ranking H2 MHC class II epitopes

| | 0101 | 0301 | 0401 | 0701 | 1101 | 1501 |
|---|---|---|---|---|---|---|
| 53 | 1 | | | | 26 | 12 |
| 82 | | 1 | | 40 | | |
| 110 | 21 | | 1 | | 1 | |
| 45 | | 6 | 38 | 1 | | |
| 4 | | −2/−1 | | −2/−1/+2 | | −2/+2 | 1 |
| 7 | 2 | | 14 | | 25 | |
| 437 | | 2 | | 36 | | |
| 202 | 7 | | 2 | | 6 | |
| 331 | 5 | 25 | 12 | | 2 | |
| 400 | 30 | | 26 | | 2 | |
| 205 | | | 44 | | | 2 |
| 536 | 3 | | | +2 | 23 | |
| 467 | 24 | 3 | | 46 | | |
| 208 | 4 | | 3 | 7 | | |
| 530 | | | | 3 | | 30 |
| 158 | 15 | +1 | 41 | | 3 | |
| 524 | | −1/+2 | +2 | | +2 | −1 | 3 |
| 392 | | 4 | | 44 | | |
| 382 | | | 4 | 31 | 43 | |
| 28 | 42 | 36 | 37 | 4 | +1 | |
| 407 | | | 27 | | 4 | |
| 120 | | 14 | 40 | | +2 | 4 |
| 486 | | 5 | | 47 | | |
| 425 | 11 | | 5 | 34 | 11 | +1 |
| 252 | | −2 | 21 | 5 | 41 | 35 |
| 265 | +2 | | 22 | +2 | 5 | |
| 244 | 44 | 16 | | +2 | 25 | 5 |
| 527 | 6 | | −1 | 30 | −1/+1 | 8 |
| 6 | | +1 | | 6 | 39 | −2 |
| 175 | 16 | | | 6 | | |
| 518 | | +2 | | | +2 | 6 |

TABLE 30.H2.3

Proposed Ii-Key/H2 MHC class II epitope hybrid peptides peptides (SEQ ID NOS 1346-1376, respectively, in order of appearance.)

| AEHA | N-term | Spacer | f-N | Epitope | f-C | C-term | LIVFM | NQ | C | Syn |
|------|--------|--------|-----|---------|-----|--------|-------|----|----|-----|
| 53 | Ac— | LRMK-ava | TH | NGKLCKLNG | IP | —NH$_2$ | 3 | 2 | + | Y |
| 82 | Ac— | LRMK-ava | PE | CDRLLSVPE | WS | —NH$_2$ | 3 | 0 | + | Y |
| 110 | Ac— | LRMK-ava | GS | FNDYEELKH | LL | —NH$_2$ | 4 | 1 | | Y |
| 45 | Ac— | LRMK-ava | HA | KDILEKTHN | GK | —NH$_2$ | 2 | 1 | | Y |
| 4 | Ac— | LRMK-ava | AI | IYLILLFTA | VR | —NH$_2$ | 8 | 0 | | N |
| 7 | Ac— | LRMK-ava | YL | ILLFTAVRG | DQ | —NH$_2$ | 6 | 1 | | N |
| 437 | Ac— | LRMK-ava | NA | ELLVLMENE | RT | —NH$_2$ | 5 | 2 | | N |
| 202 | Ac— | LRMK-ava | EQ | RTLYQNVGT | YV | —NH$_2$ | 3 | 3 | | Y |
| 331 | Ac— | LRMK-ava | TG | LRNVPQIES | RG | —NH$_2$ | 3 | 2 | | Y |
| 400 | Ac— | LRMK-ava | KM | NTQFEAVGK | EF | —NH$_2$ | 4 | 2 | | Y |
| 205 | Ac— | LRMK-ava | TL | YQNVGTYVS | VG | —NH$_2$ | 4 | 2 | | Y |
| 536 | Ac— | LRMK-ava | AG | SLSLAIMMA | GI | —NH$_2$ | 6 | 0 | | N |
| 467 | Ac— | LRMK-ava | QL | RDNVKELGN | GC | —NH$_2$ | 3 | 3 | + | Y |
| 208 | Ac— | LRMK-ava | QN | VGTYVSVGT | ST | —NH$_2$ | 3 | 2 | | N |
| 530 | Ac— | LRMK-ava | AI | YATVAGSLS | LA | —NH$_2$ | 4 | 0 | | Y |
| 158 | Ac— | LRMK-ava | SF | FRNMVWLTK | KG | —NH$_2$ | 5 | 1 | | N |
| 524 | Ac— | LRMK-ava | GV | YQILAIYAT | VA | —NH$_2$ | 5 | 1 | | N |
| 392 | Ac— | LRMK-ava | NK | VNSVIEKMN | TQ | —NH$_2$ | 4 | 4 | | Y |
| 382 | Ac— | LRMK-ava | ST | QKAFDGITN | KV | —NH$_2$ | 3 | 2 | | Y |
| 28 | Ac— | LRMK-ava | NS | TEKVDTILE | RN | —NH$_2$ | 3 | 2 | | Y |
| 407 | Ac— | LRMK-ava | AV | GKEFSNLER | RL | —NH$_2$ | 4 | 1 | | Y |
| 120 | Ac— | LRMK-ava | HL | LSSVKHFEK | VK | —NH$_2$ | 5 | 0 | | N |
| 486 | Ac— | LRMK-ava | CD | DECMNSVKN | GT | —NH$_2$ | 2 | 1 | + | Y |
| 425 | Ac— | LRMK-ava | KM | EDGFLDVWT | YN | —NH$_2$ | 4 | 1 | | Y |
| 252 | Ac— | LRMK-ava | WD | TINFESTGN | LI | —NH$_2$ | 4 | 2 | | Y |
| 265 | Ac— | LRMK-ava | AP | EYGFKISKR | GS | —NH$_2$ | 2 | 0 | | Y |
| 244 | Ac— | LRMK-ava | FS | WTLLDMWDT | IN | —NH$_2$ | 5 | 1 | | N |
| 527 | Ac— | LRMK-ava | QI | LAIYATVAG | SL | —NH$_2$ | 5 | 1 | | N |
| 6 | Ac— | LRMK-ava | IY | LILLFTAVR | GD | —NH$_2$ | 6 | 0 | | N |
| 175 | Ac— | LRMK-ava | VA | KGSYNNTSG | EQ | —NH$_2$ | 1 | 3 | | Y |
| 518 | Ac— | LRMK-ava | VK | LSSMGVYQI | LA | —NH$_2$ | 6 | 1 | | N |

TABLE 30.H2.4

Ii-Key/H2 MHC class II epitope hybrids peptides for synthesis

| AEHA | N-term | Spacer | f-N | Epitope | f-C | C-term | SEQ ID NO |
|---|---|---|---|---|---|---|---|
| 53 | Ac— | LRMK-ava | TH | NGKLCKLNG | IP | —NH₂ | 1346 |
| 82 | Ac— | LRMK-ava | PE | CDRLLSVPE | WS | —NH₂ | 1347 |
| 110 | Ac— | LRMK-ava | GS | FNDYEELKH | LL | —NH₂ | 1348 |
| 45 | Ac— | LRMK-ava | HA | KDILEKTHN | GK | —NH₂ | 1349 |
| 202 | Ac— | LRMK-ava | EQ | RTLYQNVGT | YV | —NH₂ | 1353 |
| 331 | Ac— | LRMK-ava | TG | LRNVPQIES | RG | —NH₂ | 1354 |
| 400 | Ac— | LRMK-ava | KM | NTQFEAVGK | EF | —NH₂ | 1355 |
| 205 | Ac— | LRMK-ava | TL | YQNVGTYVS | VGTST | —NH₂ | 1377 |
| 467 | Ac— | LRMK-ava | QL | RDNVKELGN | GC | —NH₂ | 1358 |
| 530 | Ac— | LRMK-ava | AI | YATVAGSLS | LA | —NH₂ | 1360 |
| 392 | Ac— | LRMK-ava | NK | VNSVIEKMN | TQ | —NH₂ | 1363 |
| 382 | Ac— | LRMK-ava | ST | QKAFDGITN | KV | —NH₂ | 1364 |
| 28 | Ac— | LRMK-ava | NS | TEKVDTILE | RN | —NH₂ | 1365 |
| 407 | Ac— | LRMK-ava | AV | GKEFSNLER | RL | —NH₂ | 1366 |
| 486 | Ac— | LRMK-ava | CD | DECMNSVKN | GT | —NH₂ | 1368 |
| 425 | Ac— | LRMK-ava | KM | EDGFLDVWT | YN | —NH₂ | 1369 |
| 252 | Ac— | LRMK-ava | WD | TINFESTGN | LI | —NH₂ | 1370 |
| 265 | Ac— | LRMK-ava | AP | EYGFKISKR | GS | —NH₂ | 1371 |
| 175 | Ac— | LRMK-ava | VA | KGSYNNTSG | EQ | —NH₂ | 1375 |

Analysis of lack of interstrain homology of MHC class II HA epitopes. The following protocol was used to determine the degree of homology among predicted MHC class II of influenza HA proteins of different strains. Given these findings, one expects no cross protection from H1 or H3 to H5, but good cross protection within H1 or H3 or H5 variants, respectively. That is, baskets of Ii-Key/influenza HA hybrid vaccine peptides offer enhanced interseasonal protection among variants of, for example, H1.

A. In computer-aligned sequences of the homologous protein in a compared strain, the sequences, which are homologous to the predicted MHC class II epitope in the reference strain are identified.

B. A MHC class II predicted epitopes of a protein in the reference strain is identical to the corresponding segment of the same protein in the compared strain. Such identity is reported in column A.

C. When the sequences differ in positions 1, 4, 6 or 9 (the hydrophobic anchor residues) by residues in the group leucine, isoleucine, valine, phenylalanine, and methionine (LIVFM; SEQ ID NO.: 790), functional identify is reported in column B.

D. When the sequences have identity (column A) or chemically possibly equivalent replacements in the anchor positions (column B), the number of additional amino acid differences is reported in column C.

E. Identify in position number or number of amino acids offset of position number of predicted epitopes in the compared strains is reported in column D.

Table discloses SEQ ID NOS: 1185, 1378, 1379, 1186, 1380, 1381, 1187, 1382, 1383, 1188, 1384, 1385, 1189, 1386, 1387, 1190, 1388, 1389, 1191, 1390, 1391, 1192, 1392, 1193, 1393, 1194, 1394, 1195, 1395, 1396, 1196, 1397, 1398, 1197, 1399, 1400, 1198, 1401, 1402, 1199, 1403, 1200, 1404, 1201, 1405, 1406, 1202, 1407, 1203, 1408, 1204, 1409, 1205, 1410, 1206, 1411, 1412, 1207, 1413, 1208, 1414 and 1415, respectively, in order of appearance.

| | AEHA | N-term | Spacer | f-N | Epitope | f-C | C-term | A | B | C | D |
|---|---|---|---|---|---|---|---|---|---|---|---|
| H5 | 444 | Ac— | LRMK-ava | NA | ELLVLMENE | RT | —NH1 | | | | |
| H1 | | | | NA | ELLVLLENE | RT | | | + | | -2 |
| H3 | | | | NA | ELLVALENQ | HT | | | | 1+ | Y |
| H5 | 112 | Ac— | LRMK-ava | GD | FNDYEELKH | LL | —NH1 | | | | |
| H1 | | | | GY | FADYEELRE | QL | | | | 2+ | Y |
| H3 | | | | DV | VPDYASLRS | LV | | | | | -1 |
| H5 | 240 | Ac— | LRMK-ava | CQ | SGRMEFFWT | IL | —NH1 | | | | |
| H1 | | | | DQ | EGRINYYWT | LL | | | | 2+ | Y |
| H3 | | | | GL | SSRISIYWT | IV | | | | 3+ | -1 |
| H5 | 55 | Ac— | LRMK-ava | TH | NGKLCDLDG | VK | —NH1 | | | | |
| H1 | | | | SH | NGKLCLLKG | IA | | | | 2+ | Y |
| H3 | | | | VP | NGTLVKTIT | DD | | | | | Y |
| H5 | 253 | Ac— | LRMK-ava | KP | NDTINFESN | GN | —NH1 | | | | |
| H1 | | | | EP | GDTIIFEAN | GN | | | | 3+ | +1/+2 |
| H3 | | | | | GDILLINST | | | | | 4+ | +2 |

-continued

| AEHA | N-term | Spacer | f-N | Epitope | f-C | C-term | A | B | C | D |
|---|---|---|---|---|---|---|---|---|---|---|
| H5 171 | Ac— | LRMK-ava | KK | NSAYPTIKR | SY | —NH1 | | | | |
| H1 | | | GK | NGLYPNLSK | SY | | | | 2+ | Y |
| H3 | | | | KYKYPALNV | | | | | | Y |
| H5 30 | Ac— | LRMK-ava | NS | TEQVDTIME | KN | —NH1 | | | | |
| H1 | | | NS | TDTVDTVLE | KN | | | + | | Y |
| H3 | | | | GTIVKTITN | | | | | | N |
| H5 268 | Ac— | LRMK-ava | AP | EYAYKIVKK | GD | —NH1 | | | | |
| H1 | | | | | | | | | | Y |
| H3 | | | AP | R-GYFKIRSG | | | | | | −1/+2 |
| H5 531 | Ac— | LRMK-ava | TY | YQILSIYST | VA | —NH1 | | | | |
| H1 | | | GV | YQILAIYST | VA | | | | 1+ | −2/−1 |
| H3 | | | | | | | | | | Y |
| H5 552 | Ac— | LRMK-ava | VA | GLSLWMCSN | GS | —NH1 | | | | |
| H1 | | | LG | AISFWMCSN | GS | | | | 2+ | −2 |
| H3 | | | | | | | | | | −2 |
| H5 211 | Ac— | LRMK-ava | QN | PTTYISVGT | ST | —NH1 | | | | |
| H1 | | | HT | ENAYVSVVS | SH | | | | 3+ | Y |
| H3 | | | VQ | ASGRITVST | RR | | | | 4+ | −2 |
| H5 178 | Ac— | LRMK-ava | TI | KRSYNNTNQ | ED | —NH1 | | | | |
| H1 | | | LS | KSYVNNKEK | EV | | | | | Y |
| H3 | | | | NVTMPNNEK | | | | | | −2/+1 |
| H5 161 | Ac— | LRMK-ava | SF | FRNVIWLIK | KN | —NH1 | | | | |
| H1 | | | SF | YRNLLWLTG | KN | | | | 2+ | Y |
| H3 | | | GF | FSRLNWLTH | SG | | | | 4+ | Y |
| H5 122 | Ac— | LRMK-ava | HL | LSRINHFEK | IQ | —NH1 | | | | |
| H1 | | | EQ | LSSVSSFER | FE | | | | 2+ | Y |
| H3 | | | SL | VASSGTLEF | IT | | | | | −1 |
| H5 407 | Ac— | LRMK-ava | KM | NTQFEAVGR | EF | —NH1 | | | | |
| H1 | | | KM | NTQFTAVGK | EF | | | | 1+ | Y |
| H3 | | | | | | | | | | −2/+2 |
| H5 525 | Ac— | LRMK-ava | VK | LESMGTYQI | LS | —NH1 | | | | |
| H1 | | | VK | LESMGVYQI | LA | | | | 1+ | −2/−1/+1/+2 |
| H3 | | | | | | | | | | −1/+2 |
| H5 305 | Ac— | LRMK-ava | NS | SMPFHNIHP | LT | —NH1 | | | | |
| H1 | | | NS | SLPFQNVHP | VT | | | | 1+ | Y |
| H3 | | | PN | DKPFQNVNR | IT | | | | | −1/+2 |
| H5 399 | Ac— | LRMK-ava | NK | VNSIIDKMN | TQ | —NH1 | | | | |
| H1 | | | NK | VNSVIEKMN | TQ | | | + | | +1 |
| H3 | | | | | | | | | | −2 |

-continued

| | AEHA | N-term | Spacer | f-N | Epitope | f-C | C-term | A | B | C | D |
|---|---|---|---|---|---|---|---|---|---|---|---|
| H5 | 432 | Ac— | LRMK-ava | KM | EDGFLDVWT | YN | —NH1 | | | | |
| H1 | | | | KV | DDGFLDIWT | YN | | | + | | Y |
| H3 | | | | | | | | | | | -1/+1 |
| H5 | 530 | Ac— | LRMK-ava | MG | TYQILSIYS | TV | —NH1 | | | | |
| H1 | | | | MG | VYQILAIYS | TV | | | | 2+ | Y |
| H3 | | | | | | | | | | | -2/-1/+1 |
| H5 | 414 | Ac— | LRMK-ava | AV | GREFNNLER | RI | —NH1 | | | | |
| H1 | | | | AV | GKEFNKLER | RM | | | | 1+ | -1 |
| H3 | | | | | | | | | | | -2 |
| H5 | 109 | Ac— | LRMK-ava | CY | PGDFNDYEE | LK | —NH1 | | | | |
| H1 | | | | CY | PGYFADYEE | LR | | | | 2+ | Y |
| H3 | | | | CY | PYDVPDYAS | LR | | | | | -2/+2 |
| H5 | 462 | Ac— | LRMK-ava | SN | VKNLYDKVR | LQ | —NH1 | | | | |
| H1 | | | | SN | VKNLYEKVK | SQ | | | + | | N |
| H3 | | | | | | | | | | | -2 |
| H5 | 362 | Ac— | LRMK-ava | GW | QGMVDGWYG | YH | —NH1 | | | | |
| H1 | | | | GW | TGMVDGWYG | YH | | | + | | Y |
| H3 | | | | GW | EGMIDGWYG | FR | | | | 1+ | -2/+1 |

Example 31

Diagnosis and Treatment of the Early Autoimmune Phase Leading to Type 1 Diabetes Mellitus Ii-Key/MHC class II hybrids containing MHC class II epitopes of principal pancreatic beta cell autoantigens can be used to diagnose individuals at risk for developing type 1 diabetes mellitus (T1DM) and for the immunotherapy of such individuals to delay or prevent onset of T1DM. A prodromal phase of many years of an autoimmune reaction to certain pancreatic beta cell self-antigens correlates with progression in some individuals to the destruction of the pancreatic beta cells, which normally synthesize insulin and release it in response to a glucose stimulus. When effective immunomodulation is created with compounds and methods of this Disclosure, this destructive process can be controlled and individuals at risk might never progress to being insulin-dependent diabetics.

Antigenic epitope peptides from pancreatic beta cell self-antigens are presented to the T-helper or immunoregulatory cells of the immune system by MHC class II molecules. A critical role for MHC class II epitopes in regulating presentation to the immune system of the autoantigens to which this destructive process is directed, is indicated by the high degree of concordance between disease susceptibility and presence of certain alleles at the MHC class II HLA-DR, HLA-DQ loci, notably the possession of HLA-DRβ1*0401, DQA1*0301/DQβ1*0302 genotypes. The protein products of these loci are the MHC class II receptors for peptides from the self-antigens to which the beta-cell destructive process is directed. The MHC class II molecules present those peptides to CD4+ immunoregulatory T cells. Prospective genotyping analyses of siblings of patients with T1DM or members of the general population indicate that some MHC class II alleles predispose to or protect from T1DM. Furthermore, the progression to disease can be over a long time interval. Autoantibodies can be identified in some individuals early in infancy. Relative risks of some MHC class II genotypes as great as 14-50 times the risk for the empirical genotypes.

Several antigens have been identified as principal targets for the autoimmune process leading to DM. These antigens include insulin (IAA), glutamic acid decarboxylase (GAA) and the protein tyrosine phosphatase (IA2). Autoantibodies can be present years before onset of the diabetes, and progression to diabetes is associated with the presence of multiple antibodies that persist over time. Additional antigens are also implicated. In particular the beta-cell glucose transporter (GLUT-2) might be a target due in part to sequence homology of segments in it and bovine casein.

The finding that certain pancreatic beta cell autoantibodies in individuals with high relative risk HLA-DR/HLA-DQ alleles correlate to developing T1DM, lead to the proposal that an immunosuppressive therapy might delay or prevent progression to T1DM. The fact that some individuals with high risk alleles, after developing such autoantibodies for a period of months subsequently lost such antibodies and did not progress to T1DM, is consistent with the view that creating and/or boosting immune response to such antigens by immunoregulatory subsets of T cells will alter progression to T1DM.

The first clinically relevant use for the compounds and methods of this Disclosure is enhancing the sensitivity of diagnosis a) to detect the presence of an autoimmune process in persons at risk of developing T1DM and b) to identify subsets of patients with certain T regulatory cells in the presence of autoantibodies to pancreatic beta cell antigens. The presence of certain T regulatory cells might correlate to either progression or continuing autoimmunity without progression to T1DM. The compounds of Table 1 will be used in ELISPOT assays (for example, IFN-γ, TGF-β, IL-10, and IL-4) in order to a) determine the potency of the response, and b) determine the patterns of cytokine responses i.e., relative levels of various cytokines, which patterns reflect relative activation of Th1, Th2, Th3 subsets of T cells. ELISPOT assays permit analysis of such subsets on a per cell basis, i.e., even in the presence of multiple subsets with competing or synergistic/additive activation patterns. One can thereby determine not only the fact that T immunoregulatory cells have been elicited by an immune response directed to the pancreatic beta-cell antigens for which Ii-Key hybrids peptides have been designed and tested, but also the balance in the Th1 vs. Th2 or other Th subsets of regulatory cells. Clearly, in some model systems for T1DM, perturbation of such regulatory balance among subsets of T cells leads to rapid progression to an aggressive autoimmune state (Herman).

The second clinical relevance for the compounds and methods of this Disclosure is modifying the immunoregulatory balance in persons progressing to T1DM in order to achieve a clinically beneficial effect. In other experiments the in vitro responses (IFN-γ vs. IL-10 vs. IL-4, both in terms of absolute levels and relative ratios) to a series of homologous Ii-Key/MHC class II (HER-2/neu) hybrids varied according to the structure of the Ii-Key-spacer element. That is, routine experimentation with systematically varied modifications of the Ii-Key/MHC class II (DM-related epitope) will lead to compounds which will modify responses of persons progressing to T1DM, in a favorable way, i.e., to slow or prevent progression to T1DM. It is established that in some autoimmune disease models in animals, induction of tolerance to one epitope or one antigen can lead to suppression of immune responses to all antigens to which a deleterious immune response is directed. It is therefore expected the induction of a disease-controlling response to one or more antigenic epitopes of a few antigens, e.g., 1A, 1A2, GAA, the use of Ii-Key/MHC class II epitope hybrids peptides will inhibit progression to T1DM. It is obvious that although only some of the hybrids containing selected antigenic epitopes will be used in clinical programs, most or all hybrids of this Disclosure will be valuable in experimentation leading to the justification of those hybrids selected for clinical programs.

The following protocol is followed in the selection and analysis of epitopes for diagnosis and immunotherapy of patients progressing to T1DM. The study is presented in terms of MHC class II epitopes of insulin, but can be extended to other diabetic autoantigens, which have been or will be identified in the future. A large number of computer-predicted epitopes that occur in insulin peptides have been reported to contain active epitopes which simulate responses by CD4+ T-cells of type I diabetics. The predicted epitopes presented by various DR alleles and suballeles should be identified and chosen. Which of the theoretically predicted epitopes are actually recognized by a patient's immune response can be determined through experiments with panels of Ii-Key hybrids with systematic variations in N-terminal lengths of the epitope-containing segment. In some instances, up to 6 or 8 potential DR3- or DR4-presented, 9-amino-acids-long, algorithm-predicted epitopes are strung out within experimentally active peptides of 9-24 amino acids in length. The specific 9 amino acid epitopes in such longer peptides, presented by any given DR allele, or suballele, have not been reported.

The steps taken to design Ii-Key peptides for this study are the following.

A. Peptides of insulin shown by others to be recognized by CD4+ T cells of type I DM patients are selected from the literature.

B. The sequence of the human insulin is obtained from Genbank.

C. Predicted DRB1*0301 and DRB1*0401 epitopes are identified by application of the Rammensee SYFPEITH program (access at: syfpeithi.bmi-heidelberg.com/Scripts/MHC-Server.dll/EpPredict.htm) to the sequences of the experimentally characterized peptides containing DR-presented sequences. In the case of relatively short peptides, the sequence for analysis by the program is extended by 5 amino acids at both the N- and C-termini.

D. The sequence of the top-scoring, epitopes predicted for DRB1*0301 and DRB1*0401 are plotted against the primary amino acid sequence of the experimentally studied peptides.

E. Ii-Key hybrid peptides are designed to contain: a) constant LRMK-ava- (SEQ ID NO.: 9) (where ava=amino-valeric acid; 5-aminopentanoic acid), and b) peptide sequences with a constant C-terminus, but varying at the N-terminus by one amino acid among members of the set, in a nested deletion pattern. N-termini are acetylated and C-termini are amidated to block catabolism by amino- and carboxy-peptidases, respectively.

F. Within a homologous series, the longest and shortest hybrids are taken for initial synthesis plus the shortest peptide of 9 amino acids being considered to be a control. Formally, since that peptide is the most C-terminal sequence, it might not comprise a biologically active epitope. That is, while it is a control, it might not be considered to be the appropriate epitope-only control for epitopes more N-terminal to it in a sequence. In addition, every other member of the series is synthesized. This limitation on the initially studied peptides within a series is made for considerations of cost and complexity of the assays, favoring instead the testing of additional possible epitopes.

G. When members of a series of peptides show biological activity, the remaining unsynthesized members of a series are then synthesized, i.e., the every other hybrids which were bypassed in the first round of syntheses.

H. Full runs of homologous peptides are tested within series for which at least some show some degree of activity, probably at 1:4 serial dilutions thorough a putative endpoint, if enough cells are available. The synthesized peptides are tested in ELISPOT assays for stimulation of either PBMC or purified CD4+ T cells from patients with recent-onset DM, who are genotyped and express preferably DR3 and/or DR4. The procedures are presented elsewhere in this Disclosure and in papers referenced herein.

I. MHC class II genotypes of the patients responding to some peptides are determined. Correlations of potency of presentation of each peptide in a homologous series with genotype (in particular DR genotype) are made. Please note that in initial studies with few patients, no statistically significant correlations are expected. As the study expands, significant epitope to genotype correlations might become apparent. The goal here is to test the hypothesis that some epitopes within hybrids become presented by certain DR suballeles, which are low responders to the epitope-only peptide. The term suballele is applied here, for example to DRB1*0301, 0302, 0303 etc., within the DRB1*03_ allele.

It is expected that at least one MHC-presented epitope will be found to be biologically active within one nested series of homologs. Perhaps two overlapping epitopes will be indicated, for example in longer hybrids of one series being presented by both DRB1*0303 and DRB1*0401 individuals while shorter hybrids of that same series are presented only by DRB1*0401 individuals. In that outcome, the DRB1*0303-presented epitope would be N-terminal to the DRB1*0401 epitope. Alternatively, only one biologically active epitope might be found within the homologous series (fine, makes life simpler). At that point, making nested deletions from the C-terminus to narrow down on (prove) the exact epitope would be considered.

Another substantial finding would be that an epitope-only peptide is presented, for example in only DRB1*0303 patients, while the hybrid of that epitope is presented in additional DRB1*03_ suballeles, from example 0301, 0303, 0305, 0307, etc. If that finding were further supported in studies with 1:4 serial dilutions of peptides (to define end-points in a manner like the PGCC data in the Vaccine 2000 paper, one might then claim that hybrids allow presentation by additional suballeles, thereby escaping in part the requirement for a basket of epitopes for a clinically useful peptide vaccines The basket of epitopes hypothesis is that many peptides must be given in one injection, in order that as many patients in a general population, with many different MHC class II alleles, can be covered each by at least one or a few of the mixture of peptides. If a parallel finding of spreading presentation to other alleles occurred, for example from DRB1*0301 to 0401, 0501, 0701, etc., the significance of this effect would be greater. The likelihood of inserting epitopes into the hybrid cassette to benefit spreading of presentation to other suballeles but not to additional alleles is anticipated.

Because no one has reported the presence of CD4+ T cell-stimulating antigenic epitopes in the longer peptides taken for the study, the precise 9-amino-acids-long sequences bound into antigenic epitope-binging trough (desotope) of the HLA-DR molecules is not known. Perhaps 2/3 of the predicted MHC class II epitopes are not recognized for several reasons. All of the predicted epitopes might contain specified amino acids in sequence positions, in a pattern highly correlating with those in either known presented peptides and/or peptides eluted from HLA-DR molecules and sequence-determined. But in practice, some of those potential epitopes are cleaved during processing of the antigen, or are competed in binding to MHC. At least 5 mechanisms selecting against computer-algorithm-predicted epitopes actually being biologically active have been established by Sercarz. For example, by overlapping or adjacent MHC Class II epitopes.

The following analysis is completed with the deduced sequence of human proinsulin precursor [gi:4557671]. After removal of the precursor signal peptide, proinsulin is post-translationally cleaved into two chains (peptide A and peptide B) that are covalently linked via two disulfide bonds. Binding of this mature form of insulin to the insulin receptor (INSR) stimulates glucose uptake. The sequence is:

1 malwmrllpl lallalwgpd paaafvnqhl cgshlvealy lvcgergffy tpktrreaed 61 lqvgqvelgg gpgagslqpl alegslqkrg iveqcctsic slyqlenycn (SEQ ID NO.: 1426)

The relevant segments are: Summary of above:

| | |
|---|---|
| 1-24 | signal peptide |
| 1-110 | preproinsulin |
| 25-110 | proinsulin |
| 25-54 | peptide B |
| 90-110 | peptide A |
| 55-89 | C peptide |

B fvnqhl cgshlvealy lvcgergffy tpkt (SEQ ID NO.: 1417)

Reported epitope in B9-23 (Wegman): shlvealy lvcger (residues 9-22 of SEQ ID NO: 1417)

Reported epitope in B1-17: fvnqhl cgshlvealy l

```
fvnqhl cgshlvealy lvcgergffy tpkt
```

| DRB1*0301 | |
|---|---|
| 14-2 | aly lycger |
| 15-23 | ly lvcgerg |
| 13-21 | ealy lvcge |
| 5-13 | hl cgshlve |
| 3-11 | nqhl cgshl |
| 4-12 | qhl cgshlv |
| **DRB1*0401** | |
| 3-11 | nqhl cgshl |
| 8-16 | gshlvealy |
| 9-17 | shlvealy l |
| 12-20 | vealy lvcg |
| 14-22 | aly lycger |
| 15-23 | ly lvcgerg |

(numbers refer to residue numbers of SEQ ID NO: 1417)

TABLE 31.1

Ii-Key/MHC class II epitope hybrids with insulin epitopes.

| Peptide # | AE# | N-term | SEQ | C-term | 1st aa | SEQ ID NO |
|---|---|---|---|---|---|---|
| 31.1.1 | D1 | Ac—LRMK-ava- | NQHLCGSHLVEALY | —$NH_2$ | 3 | 1418 |
| 31.1.2 | D2 | Ac—LRMK-ava- | QHLCGSHLVEALY | —$NH_2$ | 4 | 1419 |
| 31.1.3 | D3 | Ac—LRMK-ava- | HLCGSHLVEALY | —$NH_2$ | 5 | 1420 |
| 31.1.4 | D4 | Ac—LRMK-ava- | LCGSHLVEALY | —$NH_2$ | 6 | 1421 |
| 31.1.5 | D5 | Ac— | NQHLCGSHLVEALY | —$NH_2$ | 3 | 1422 |
| 31.1.6 | D6 | Ac—LRMK-ava- | VEALYLVCGERGFFYT | —$NH_2$ | 12 | 1423 |
| 31.1.7 | D7 | Ac—LRMK-ava- | EALYLVCGERGFFYT | —$NH_2$ | 13 | 1424 |

TABLE 31.1-continued

Ii-Key/MHC class II epitope hybrids with insulin epitopes.

| Peptide # | AE# | N-term | SEQ | C-term | 1st aa | SEQ ID NO |
|---|---|---|---|---|---|---|
| 31.1.8 | D8 | Ac-LRMK-ava- | ALYLVCGERGFFYT | -NH$_2$ | 14 | 1425 |
| 31.1.9 | D9 | Ac-LRMK-ava- | LYLVCGERGFFYT | -NH$_2$ | 15 | 1426 |
| 31.1.10 | D10 | Ac-LRMK-ava- | YLVCGERGFFYT | -NH$_2$ | 16 | 1427 |
| 31.1.11 | D11 | Ac- | VEALYLVCGERGFFYT | -NH$_2$ | 12 | 1428 |

A g iveqcctsic slyqlenycn

Reported epitope in A1-21: g iveqcctsic slyqlenycn g iveqcctsic slyqlenycn

DRB1*0301 (numbers refer to residue numbers of SEQ ID NO: 1429)

| DRB1*0301 | |
|---|---|
| 7-15 | ctsic slyq |
| 2-10 | iveqcctsi |
| 3-11 | veqcctsic |
| 5-13 | qcctsic sl |
| DRB1*0401 | |
| 7-15 | ctsic slyq |
| 4-12 | eqcctsic s |
| 1-9 | g iveqccts |

(numbers refer to residue numbers of SEQ ID NO: 1429)

TABLE 31.2

Ii-Key/MHC class II epitope hybrids with insulin epitopes.

| Peptide # | AE# | N-term | SEQ | C-term | 1st aa | SEQ ID NO |
|---|---|---|---|---|---|---|
| 31.2.1 | D21 | Ac-LRMK-ava- | GIVEQCCTSICSLYQ | -NH$_2$ | 1 | 1430 |
| 31.2.2 | D22 | Ac-LRMK-ava- | IVEQCCTSICSLYQ | -NH$_2$ | 2 | 1431 |
| 31.2.3 | D23 | Ac-LRMK-ava- | VEQCCTSICSLYQ | -NH$_2$ | 3 | 1432 |
| 31.2.4 | D24 | Ac-LRMK-ava- | EQCCTSICSLYQ | -NH$_2$ | 4 | 1433 |
| 31.2.5 | D25 | Ac-LRMK-ava- | QCCTSICSLYQ | -NH$_2$ | 5 | 1434 |
| 31.2.6 | D26 | Ac-LRMK-ava- | CCTSICSLYQ | -NH$_2$ | 6 | 1435 |
| 31.2.7 | D27 | Ac-LRMK-ava- | CTSICSLYQ | -NH$_2$ | 7 | 1436 |
| 31.2.8 | D28 | Ac- | GIVEQCCTSICSLYQ | -NH$_2$ | 1 | 1437 |

C Reported epitope in C8-24: lgg gpgagslqpl alegslqkr (SEQ ID NO.: 1438)

Reported epitope in C1-35: rreaed lqvggvelgg gpgagslqpl alegslqkr rreaed lqvggvelgg gpgagslqpl alegslqkr DRB1*0301 (numbers refer to residue numbers of SEQ ID NO: 1438)

| DRB1*0301 | |
|---|---|
| 3-11 | eaed lqvgq |
| 9-17 | vgqvelgg g |
| 11-19 | qvelgg gpg |
| 4-12 | aed lqvgqv |
| 6-14 | d lqvgqvel |
| DRB1*0401 | |
| 3-11 | eaed lqvgq |
| 6-14 | d lqvgqvel |
| 9-17 | vgqvelgg g |
| 1-9 | rreaed lqv |
| 11-19 | qvelgg gpg |
| 14-22 | lgg gpgags |
| 16-24 | g gpgagslq |
| 17-25 | gpgagslqp |

(numbers refer to residue numbers of SEQ ID NO: 1438)

TABLE 31.3

Ii-Key/MHC class II epitope hybrids with insulin epitopes.

| Peptide # | AE# | N-term | SEQ | C-term | 1st aa | SEQ ID NO |
|---|---|---|---|---|---|---|
| 31.3.1 | D31 | Ac—LRMK- | RREAEDLQVGGVEL | —NH$_2$ | 1 | 1439 |
| | | ava- | | | | |
| 31.3.2 | D32 | Ac—LRMK- | REAEDLQVGGVEL | —NH$_2$ | 2 | 1440 |
| | | ava- | | | | |
| 31.3.3 | D33 | Ac—LRMK- | EAEDLQVGGVEL | —NH$_2$ | 3 | 1441 |
| | | ava- | | | | |
| 31.3.4 | D34 | Ac—LRMK- | AEDLQVGGVEL | —NH$_2$ | 4 | 1442 |
| | | ava- | | | | |
| 31.3.5 | D35 | Ac—LRMK- | EDLQVGGVEL | —NH$_2$ | 5 | 1443 |
| | | ava- | | | | |
| 31.3.6 | D36 | Ac— | RREAEDLQVGGVEL | —NH$_2$ | 1 | 1444 |
| 31.3.7 | D37 | Ac—LRMK- | LQVGGVELGGGPGA | —NH$_2$ | 7 | 1445 |
| | | ava- | | | | |
| 31.3.8 | D38 | Ac—LRMK- | QVGGVELGGGPGA | —NH$_2$ | 8 | 1446 |
| | | ava- | | | | |
| 31.3.9 | D39 | Ac—LRMK- | VGGVELGGGPGA | —NH$_2$ | 9 | 1447 |
| | | ava- | | | | |
| 31.3.10 | D40 | Ac—LRMK- | GGVELGGGPGA | —NH$_2$ | 10 | 1448 |
| | | ava- | | | | |
| 31.3.11 | D41 | Ac—LRMK- | GVELGGGPGA | —NH$_2$ | 11 | 1449 |
| | | ava- | | | | |
| 31.3.12 | D42 | Ac— | LQVGGVELGGGPGA | —NH2 | 7 | 1450 |

SEQUENCE LISTING (1455 sequences)

SEQ ID NO: 1 - protein, 16 aa, Unknown
  Description of Unknown: Mammalian li-key peptide
LRMKLPKPPKPVSKMR

SEQ ID NO: 2 - protein, 16 aa, Artificial Sequence
  Description of Artificial Sequence: Modified mammalian li-key peptide
YRMKLPKPPKPVSKMR

SEQ ID NO: 3 - protein, 4 aa, Artificial Sequence
  Description of Artificial Sequence: Modified mammalian li-key peptide
LRMK

SEQ ID NO: 4 - protein, 7 aa, Artificial Sequence
  Description of Artificial Sequence: Modified mammalian li-key peptide
LRMKLPK

SEQ ID NO: 5 - protein, 8 aa, Artificial Sequence
  Description of Artificial Sequence: Modified mammalian li-key peptide
LRMKLPKS

SEQ ID NO: 6 - protein, 11 aa, Artificial Sequence
  Description of Artificial Sequence: Modified mammalian li-key peptide
LRMKLPKSAKP

SEQ ID NO: 7 - protein, 14 aa, Artificial Sequence
  Description of Artificial Sequence: Modified mammalian li-key peptide
LRMKLPKSAKPVSK

SEQ ID NO: 8 - protein, 4 aa, Artificial Sequence
  Description of Artificial Sequence: Modified mammalian li-key peptide
LRMK

SEQ ID NO: 9 - protein, 5 aa, Artificial Sequence
  Description of Artificial Sequence: Modified mammalian li-key peptide
  MOD_RES (5)..(5): Ava
LRMKX

SEQ ID NO: 10 - protein, 626 aa, Arachis hypogaea
MRGRVSPLMLLLGILVLASVSATHAKSSPYQKKTENPCAQRCLQSCQQEPDDLKQKACESRCTKLEYDPRCVYDPRGHTGTTNQRSPPGERTRGRQPGDYDDDRRQPRREEGGRWGPAGPREREREEDWRQPREDWRRPSHQQPRKIRPEGREGEQEWGTPGSHVREETSRNNPFYFPSRRFSTRYGNQNGRIRVLQRFDQRSRQFQNLQNHRIVQIEAKPNTLVLPKHADADNILVIQQGQATVTVANGNNRKSFNLDEGHALRIPSGFISYILNRHDNQNLRVAKISMPVNTPGQFEDFFPASSRDQSSYLQGFSRNTLEAAFNAEFNEIRRVLLEENAGGEQEERGQRRWSTRSSENNEGVIVKVSKEHVEELTKHAKSVSKKGSEEEGDITNPINLREGEPDLSNNFGKLFEVKPDKKNPQLQDLDMMLTCVEIKEGALMLPHFNSKAMVIVVVNKGTGNLELVAVRKEQQQRGRREEEEDEDEEEEGSNREVRRYTARLKEGDVFIMPAAHPVAINASSELHLLGFGINAENNHRIFLAGDKDNVIDQIEKQAKDLAFPGSGEQVEKLIKNQKESHFVSARPQSQSQSPSSPEKESPEKEDQEEENQGGKGPLLSILKAFN

SEQ ID NO: 11 - protein, 9 aa, Arachis hypogaea
VKPDKKNPQ

SEQ ID NO: 12 - protein, 9 aa, Arachis hypogaea
IRVLQRFDQ

SEQ ID NO: 13 - protein, 9 aa, Arachis hypogaea
LQGFSRNTL

SEQ ID NO: 14 - protein, 9 aa, Arachis hypogaea
MVIVVVNKG

SEQ ID NO: 15 - protein, 9 aa, Arachis hypogaea
VVNKGTGNL

SEQ ID NO: 16 - protein, 9 aa, Arachis hypogaea
VRRYTARLK

SEQ ID NO: 17 - protein, 9 aa, Arachis hypogaea
LQNHRIVQI

SEQ ID NO: 18 - protein, 9 aa, Arachis hypogaea
FQNLQNHRI

SEQ ID NO: 19 - protein, 9 aa, Arachis hypogaea
MLLLGILVL

SEQ ID NO: 20 - protein, 9 aa, Arachis hypogaea
LLGILVLAS

SEQ ID NO: 21 - protein, 9 aa, Arachis hypogaea
MRGRVSPLM

SEQ ID NO: 22 - protein, 9 aa, Arachis hypogaea
LVLASVSAT

SEQ ID NO: 23 - protein, 9 aa, Arachis hypogaea
LDMMLTCVE

SEQ ID NO: 24 - protein, 9 aa, Arachis hypogaea
LRIPSGFIS

SEQ ID NO: 25 - protein, 9 aa, Arachis hypogaea
FISYILNRH

SEQ ID NO: 26 - protein, 9 aa, Arachis hypogaea
LNRHDNQNL

SEQ ID NO: 27 - protein, 9 aa, Arachis hypogaea
FNAEFNEIR

SEQ ID NO: 28 - protein, 9 aa, Arachis hypogaea
FNEIRRVLL

SEQ ID NO: 29 - protein, 9 aa, Arachis hypogaea
VLLEENAGG

SEQ ID NO: 30 - protein, 14 aa, Artificial Sequence
  Description of Artificial Sequence: Synthetic hybrid peptide
  MOD_RES (5)..(5): Ava
LRMKXIRVLQRFDQ

SEQ ID NO: 31 - protein, 14 aa, Artificial Sequence
  Description of Artificial Sequence: Synthetic hybrid peptide
  MOD_RES (5)..(5): Ava
LRMKXMRGRVSPLM

SEQ ID NO: 32 - protein, 28 aa, Artificial Sequence
  Description of Artificial Sequence: Synthetic hybrid peptide
  MOD_RES (5)..(5): Ava
LRMKXMRGRVSPLMLLLGILVLASVSAT

SEQ ID NO: 33 - protein, 14 aa, Artificial Sequence
  Description of Artificial Sequence: Synthetic hybrid peptide
  MOD_RES (5)..(5): Ava
LRMKXFQNLQNHRI

SEQ ID NO: 34 - protein, 17 aa, Artificial Sequence
  Description of Artificial Sequence: Synthetic hybrid peptide
  MOD_RES (5)..(5): Ava
LRMKXFQNLQNHRIVQI

SEQ ID NO: 35 - protein, 14 aa, Artificial Sequence
  Description of Artificial Sequence: Synthetic hybrid peptide
  MOD_RES (5)..(5): Ava
LRMKXLDMMLTCVE

SEQ ID NO: 36 - protein, 14 aa, Artificial Sequence
  Description of Artificial Sequence: Synthetic hybrid peptide
  MOD_RES (5)..(5): Ava
LRMKXLRIPSGFIS

SEQ ID NO: 37 - protein, 25 aa, Artificial Sequence
  Description of Artificial Sequence: Synthetic hybrid peptide
  MOD_RES (5)..(5): Ava
LRMKXLRIPSGFISYILNRHDNQNL

SEQ ID NO: 38 - protein, 10 aa, Arachis hypogaea
NNFGKLFEVK

SEQ ID NO: 39 - protein, 10 aa, Arachis hypogaea
SYLQEFSRNT

SEQ ID NO: 40 - protein, 10 aa, Arachis hypogaea
RRYTARLKEG

SEQ ID NO: 41 - protein, 10 aa, Arachis hypogaea
FNAEFNEIRR

SEQ ID NO: 42 - protein, 10 aa, Arachis hypogaea
GTGNLELVAV

SEQ ID NO: 43 - protein, 22 aa, Artificial Sequence
  Description of Artificial Sequence: Synthetic hybrid peptide
  MOD_RES (5)..(5): Ava
LRMKXNNFGKLFEVKPDKKNPQ

SEQ ID NO: 44 - protein, 14 aa, Artificial Sequence
  Description of Artificial Sequence: Synthetic hybrid peptide
  MOD_RES (5)..(5): Ava
LRMKXLQGFSRNTL

SEQ ID NO: 45 - protein, 14 aa, Artificial Sequence
  Description of Artificial Sequence: Synthetic hybrid peptide
  MOD_RES (5)..(5): Ava
LRMKXVRRYTARLK

SEQ ID NO: 46 - protein, 14 aa, Artificial Sequence
  Description of Artificial Sequence: Synthetic hybrid peptide
  MOD_RES (5)..(5): Ava
LRMKXMVIVVVNKG

SEQ ID NO: 47 - protein, 14 aa, Artificial Sequence
  Description of Artificial Sequence: Synthetic hybrid peptide
  MOD_RES (5)..(5): Ava
LRMKXVVNKGTGNL

SEQ ID NO: 48 - protein, 23 aa, Artificial Sequence
  Description of Artificial Sequence: Synthetic hybrid peptide
  MOD_RES (5)..(5): Ava
LRMKXMVIVVVNKGTGNLELVAV

SEQ ID NO: 49 - protein, 14 aa, Artificial Sequence
  Description of Artificial Sequence: Synthetic hybrid peptide
  MOD_RES (5)..(5): Ava
LRMKXFNAEFNEIR

SEQ ID NO: 50 - protein, 14 aa, Artificial Sequence
  Description of Artificial Sequence: Synthetic hybrid peptide
  MOD_RES (5)..(5): Ava
LRMKXFNEIRRVLL

SEQ ID NO: 51 - protein, 14 aa, Artificial Sequence
  Description of Artificial Sequence: Synthetic hybrid peptide
  MOD_RES (5)..(5): Ava
LRMKXVLLEENAGG

SEQ ID NO: 52 - protein, 24 aa, Artificial Sequence
  Description of Artificial Sequence: Synthetic hybrid peptide
  MOD_RES (5)..(5): Ava
LRMKXFNAEFNEIRRVLLEENAGG

SEQ ID NO: 53 - protein, 156 aa, Arachis hypogaea
MAKLTILVALALFLLAAHASARQQWELQGDRRCQSQLERANLRPCEQHLMQKIQRDEDSYERDPYSPSQDPYSPSPYDRRGAGSSQHQERCCNELNEFENNQRCMCEALQQIMENQSDRLQGRQQEQQFKRELRNLPQQCGLRAPQRCDLDVESGG

SEQ ID NO: 54 - protein, 15 aa, Arachis hypogaea
RQQWELQGDRRCQSQ

SEQ ID NO: 55 - protein, 20 aa, Arachis hypogaea
LRPCEQHLMQKIQRDEDSYE

SEQ ID NO: 56 - protein, 10 aa, Arachis hypogaea
HQERCCNELN

SEQ ID NO: 57 - protein, 10 aa, Arachis hypogaea
QRCMCEALQQ

SEQ ID NO: 58 - protein, 10 aa, Arachis hypogaea
PQQCGLRAPQ

SEQ ID NO: 59 - protein, 20 aa, Artificial Sequence
  Description of Artificial Sequence: Synthetic hybrid peptide
  MOD_RES (5)..(5): Ava
LRMKXRQQWELQGDRRCQSQ

SEQ ID NO: 60 - protein, 25 aa, Artificial Sequence
  Description of Artificial Sequence: Synthetic hybrid peptide
  MOD_RES (5)..(5): Ava
LRMKXLRPCEQHLMQKIQRDEDSYE

SEQ ID NO: 61 - protein, 15 aa, Artificial Sequence
  Description of Artificial Sequence: Synthetic hybrid peptide
  MOD_RES (5)..(5): Ava
LRMKXHQERCCNELN

SEQ ID NO: 62 - protein, 15 aa, Artificial Sequence
  Description of Artificial Sequence: Synthetic hybrid peptide
  MOD_RES (5)..(5): Ava
LRMKXQRCMCEALQQ

SEQ ID NO: 63 - protein, 15 aa, Artificial Sequence
  Description of Artificial Sequence: Synthetic hybrid peptide
  MOD_RES (5)..(5): Ava
LRMKXPQQCGLRAPQ

SEQ ID NO: 64 - protein, 9 aa, Arachis hypogaea
ILVALALFL

SEQ ID NO: 65 - protein, 9 aa, Arachis hypogaea
LQGDRRCQS

SEQ ID NO: 66 - protein, 9 aa, Arachis hypogaea
LTILVALAL

SEQ ID NO: 67 - protein, 9 aa, Arachis hypogaea
LMQKIQRDE

SEQ ID NO: 68 - protein, 9 aa, Arachis hypogaea
LFLLAAHAS

SEQ ID NO: 69 - protein, 9 aa, Arachis hypogaea
LVALALFLL

SEQ ID NO: 70 - protein, 9 aa, Arachis hypogaea
LRPCEQHLM

SEQ ID NO: 71 - protein, 9 aa, Arachis hypogaea
LALFLLAAH

SEQ ID NO: 72 - protein, 9 aa, Arachis hypogaea
LRNLPQQCG

SEQ ID NO: 73 - protein, 9 aa, Arachis hypogaea
LERANLRPC

SEQ ID NO: 74 - protein, 9 aa, Arachis hypogaea
FLLAAHASA

SEQ ID NO: 75 - protein, 9 aa, Arachis hypogaea
YDRRGAGSS

SEQ ID NO: 76 - protein, 9 aa, Arachis hypogaea
FENNQRCMC

SEQ ID NO: 77 - protein, 14 aa, Artificial Sequence
  Description of Artificial Sequence: Synthetic hybrid peptide
  MOD_RES (5)..(5): Ava
LRMKXILVALALFL

SEQ ID NO: 78 - protein, 14 aa, Artificial Sequence
  Description of Artificial Sequence: Synthetic hybrid peptide
  MOD_RES (5)..(5): Ava
LRMKXLTILVALAL

SEQ ID NO: 79 - protein, 14 aa, Artificial Sequence
  Description of Artificial Sequence: Synthetic hybrid peptide
  MOD_RES (5)..(5): Ava
LRMKXLVALALFLL

SEQ ID NO: 80 - protein, 17 aa, Artificial Sequence
  Description of Artificial Sequence: Synthetic hybrid peptide
  MOD_RES (5)..(5): Ava
LRMKXLTILVALALFLL

SEQ ID NO: 81 - protein, 14 aa, Artificial Sequence
  Description of Artificial Sequence: Synthetic hybrid peptide
  MOD_RES (5)..(5): Ava
LRMKXLRNLPQQCG

SEQ ID NO: 82 - protein, 14 aa, Artificial Sequence
  Description of Artificial Sequence: Synthetic hybrid peptide
  MOD_RES (5)..(5): Ava
LRMKXYDRRGAGSS

SEQ ID NO: 83 - protein, 14 aa, Artificial Sequence
  Description of Artificial Sequence: Synthetic hybrid peptide
  MOD_RES (5)..(5): Ava
LRMKXFENNQRCMC

SEQ ID NO: 84 - protein, 10 aa, Arachis hypogaea
HASARQQWEL

SEQ ID NO: 85 - protein, 10 aa, Arachis hypogaea
QWELQGDRRC

SEQ ID NO: 86 - protein, 10 aa, Arachis hypogaea
DRRCQSQLER

SEQ ID NO: 87 - protein, 9 aa, Arachis hypogaea
LRPCEQHLM

SEQ ID NO: 88 - protein, 10 aa, Arachis hypogaea
KIQRDEDSYE

SEQ ID NO: 89 - protein, 10 aa, Arachis hypogaea
KRELRNLPQQ

SEQ ID NO: 90 - protein, 14 aa, Artificial Sequence
  Description of Artificial Sequence: Synthetic hybrid peptide
  MOD_RES (5)..(5): Ava
LRMKXLQGDRRCQS

SEQ ID NO: 91 - protein, 14 aa, Artificial Sequence
  Description of Artificial Sequence: Synthetic hybrid peptide
  MOD_RES (5)..(5): Ava
LRMKXLMQKIQRDE

SEQ ID NO: 92 - protein, 14 aa, Artificial Sequence
  Description of Artificial Sequence: Synthetic hybrid peptide
  MOD_RES (5)..(5): Ava
LRMKXLRPCEQHLM

SEQ ID NO: 93 - protein, 20 aa, Artificial Sequence
  Description of Artificial Sequence: Synthetic hybrid peptide
  MOD_RES (5)..(5): Ava
LRMKXLRPCEQHLMKIQRDE

SEQ ID NO: 94 - protein, 19 aa, Artificial Sequence
  Description of Artificial Sequence: Synthetic hybrid peptide
  MOD_RES (5)..(5): Ava
LRMKXLERANLRPCEQHLM

SEQ ID NO: 95 - protein, 20 aa, Artificial Sequence
  Description of Artificial Sequence: Synthetic hybrid peptide
  MOD_RES (5)..(5): Ava
LRMKXFLLAAHASARQQWEL

SEQ ID NO: 96 - protein, 507 aa, Arachis hypogaea
RQQPEENACQFQRLNAQRPDNRIESEGGYIETWNPNNQEFECAGVALSRLVLRRNALRRPFYSNAPQEIFIQQGRGYFGLIFPGCPRHYEEPHTQGRRSQSQRPPRRLQGEDQSQQQRDSHQKVHRFDEGDLIAVPTGVAFWLYNDHDTDVVAVSLTDTNNNDNQLDQFPRRFNLAGNTEQEFLRYQQQSRQSRRRSLPYSPYSPQSQPRQEEREFSPRGQHSRRERAGQEEENEGGNIFSGFTPEFLEQAFQVDDRQIVQNLRGETESEEEGAIVTVRGGLRILSPDRKRRADEEEEYDEDEYEYDEEDRRRGRGSRGRGNGIEETICTASAKKNIGRNRSPDIYNPQAGSLKTANDLNLLILRWLGPSAEYGNLYRNALFVAHYNTNAHSIIYRLRGRAHVQVVDSNGNRVYDEELQEGHVLVVPQNFAVAGKSQSENFEYVAFKTDSRPSIANLAGENSVIDNLPEEVVANSYGLQREQARQLKNNNPFKFFVPPSQQSPRAVA

SEQ ID NO: 97 - protein, 9 aa, Arachis hypogaea
YRLRGRAHV

SEQ ID NO: 98 - protein, 9 aa, Arachis hypogaea
IIYRLRGRA

SEQ ID NO: 99 - protein, 9 aa, Arachis hypogaea
FKTDSRPSI

SEQ ID NO: 100 - protein, 9 aa, Arachis hypogaea
VRGGLRILS

SEQ ID NO: 101 - protein, 9 aa, Arachis hypogaea
IVTVRGGLR

SEQ ID NO: 102 - protein, 9 aa, Arachis hypogaea
LRILSPDRK

SEQ ID NO: 103 - protein, 9 aa, Arachis hypogaea
FQVDDRQIV

SEQ ID NO: 104 - protein, 9 aa, Arachis hypogaea
LRWLGPSAE

SEQ ID NO: 105 - protein, 9 aa, Arachis hypogaea
LILRWLGPS

SEQ ID NO: 106 - protein, 9 aa, Arachis hypogaea
FNLAGNTEQ

SEQ ID NO: 107 - protein, 9 aa, Arachis hypogaea
LVVPQNFAV

SEQ ID NO: 108 - protein, 9 aa, Arachis hypogaea
VQVVDSNGN

SEQ ID NO: 109 - protein, 9 aa, Arachis hypogaea
VVDSNGNRV

SEQ ID NO: 110 - protein, 9 aa, Arachis hypogaea
FVAHYNTNA

SEQ ID NO: 111 - protein, 14 aa, Artificial Sequence
  Description of Artificial Sequence: Synthetic hybrid peptide
  MOD_RES (5)..(5): Ava
LRMKXIIYRLRGRA

SEQ ID NO: 112 - protein, 14 aa, Artificial Sequence
  Description of Artificial Sequence: Synthetic hybrid peptide
  MOD_RES (5)..(5): Ava
LRMKXYRLRGRAHV

SEQ ID NO: 113 - protein, 16 aa, Artificial Sequence
  Description of Artificial Sequence: Synthetic hybrid peptide
  MOD_RES (5)..(5): Ava
LRMKXIIYRLRGRAHV

SEQ ID NO: 114 - protein, 14 aa, Artificial Sequence
  Description of Artificial Sequence: Synthetic hybrid peptide
  MOD_RES (5)..(5): Ava
LRMKXFKTDSRPSI

SEQ ID NO: 115 - protein, 14 aa, Artificial Sequence
  Description of Artificial Sequence: Synthetic hybrid peptide
  MOD_RES (5)..(5): Ava
LRMKXLILRWLGPS

SEQ ID NO: 116 - protein, 14 aa, Artificial Sequence
  Description of Artificial Sequence: Synthetic hybrid peptide
  MOD_RES (5)..(5): Ava
LRMKXLRWLGPSAE

SEQ ID NO: 117 - protein, 16 aa, Artificial Sequence
  Description of Artificial Sequence: Synthetic hybrid peptide
  MOD_RES (5)..(5): Ava
LRMKXLILRWLGPSAE

SEQ ID NO: 118 - protein, 14 aa, Artificial Sequence
  Description of Artificial Sequence: Synthetic hybrid peptide
  MOD_RES (5)..(5): Ava
LRMKXFQVDDRQIV

SEQ ID NO: 119 - protein, 14 aa, Artificial Sequence
  Description of Artificial Sequence: Synthetic hybrid peptide
  MOD_RES (5)..(5): Ava
LRMKXFNLAGNTEQ

SEQ ID NO: 120 - protein, 14 aa, Artificial Sequence
  Description of Artificial Sequence: Synthetic hybrid peptide
  MOD_RES (5)..(5): Ava
LRMKXLVVPQNFAV

SEQ ID NO: 121 - protein, 14 aa, Artificial Sequence
  Description of Artificial Sequence: Synthetic hybrid peptide
  MOD_RES (5)..(5): Ava
LRMKXVQVVDSNGN

SEQ ID NO: 122 - protein, 14 aa, Artificial Sequence
  Description of Artificial Sequence: Synthetic hybrid peptide
  MOD_RES (5)..(5): Ava
LRMKXVVDSNGNRV

SEQ ID NO: 123 - protein, 16 aa, Artificial Sequence
  Description of Artificial Sequence: Synthetic hybrid peptide
  MOD_RES (5)..(5): Ava
LRMKXVQVVDSNGNRV

SEQ ID NO: 124 - protein, 14 aa, Artificial Sequence
  Description of Artificial Sequence: Synthetic hybrid peptide
  MOD_RES (5)..(5): Ava
LRMKXFVAHYNTNA

SEQ ID NO: 125 - protein, 15 aa, Arachis hypogaea
VTVRGGLRILSPDRK

SEQ ID NO: 126 - protein, 14 aa, Artificial Sequence
  Description of Artificial Sequence: Synthetic hybrid peptide
  MOD_RES (5)..(5): Ava
LRMKXIVTVRGGLR

SEQ ID NO: 127 - protein, 14 aa, Artificial Sequence
  Description of Artificial Sequence: Synthetic hybrid peptide
  MOD_RES (5)..(5): Ava
LRMKXVRGGLRILS

SEQ ID NO: 128 - protein, 21 aa, Artificial Sequence
  Description of Artificial Sequence: Synthetic hybrid peptide
  MOD_RES (5)..(5): Ava
LRMKXIVTVRGGLRILSPDRK

SEQ ID NO: 129 - protein, 21 aa, Artificial Sequence
  Description of Artificial Sequence: Synthetic hybrid peptide
  MOD_RES (5)..(5): Ava
LRMKXIVTVRGGLRILSPDRK

SEQ ID NO: 130 - protein, 17 aa, Unknown
  Description of Unknown Organism: Th1-skewing peptide
ISQAVHAAHAEINAAGR

SEQ ID NO: 131 - protein, 17 aa, Unknown
  Description of Unknown Organism: Wild type Th1-skewing peptide
ISQAVHAAHAEINEAGR

SEQ ID NO: 132 - protein, 17 aa, Felis domesticus
LFLTGTPDEYVEQVAQY

SEQ ID NO: 133 - protein, 16 aa, Felis domesticus
EQVAQYKALPVVLENA

SEQ ID NO: 134 - protein, 17 aa, Felis domesticus
KALPVVLENARILKNCV

SEQ ID NO: 135 - protein, 88 aa, Felis catus
MLDAALPPCPTVAATADCEICPAVKRDVDLFLTGTPDEYVEQVAQYKALPVVLENARILKNCVDAKMTEEDKENALSLLDKIYTSPLC

SEQ ID NO: 136 - protein, 109 aa, Felis catus
MRGALLVLALLVTQALGVKMAETCPIFYDVFFAVANGNELLLDLSLTKVNATEPERTAMKKIQDCYVENGLISRVLDGLVMTTISSSKDCMGEAVQNTVEDLKLNTLGR

SEQ ID NO: 137 - protein, 9 aa, Felis catus
YKALPVVLE

SEQ ID NO: 138 - protein, 9 aa, Felis catus
VVLENARIL

SEQ ID NO: 139 - protein, 9 aa, Felis catus
VAQYKALPV

SEQ ID NO: 140 - protein, 9 aa, Felis catus
YVEQVAQYK

SEQ ID NO: 141 - protein, 9 aa, Felis catus
VKRDVDLFL

SEQ ID NO: 142 - protein, 9 aa, Felis catus
ICPAVKRDV

SEQ ID NO: 143 - protein, 9 aa, Felis catus
LSLLDKIYT

SEQ ID NO: 144 - protein, 9 aa, Felis catus
LDKIYTSPL

SEQ ID NO: 145 - protein, 9 aa, Felis catus
LFLTGTPDE

SEQ ID NO: 146 - protein, 14 aa, Artificial Sequence
  Description of Artificial Sequence: Synthetic hybrid peptide
  MOD_RES (5)..(5): Ava
LRMKXVAQYKALPV

SEQ ID NO: 147 - protein, 14 aa, Artificial Sequence
  Description of Artificial Sequence: Synthetic hybrid peptide
  MOD_RES (5)..(5): Ava
LRMKXYKALPVVLE

SEQ ID NO: 148 - protein, 14 aa, Artificial Sequence
  Description of Artificial Sequence: Synthetic hybrid peptide
  MOD_RES (5)..(5): Ava
LRMKXVVLENARIL

SEQ ID NO: 149 - protein, 14 aa, Artificial Sequence
  Description of Artificial Sequence: Synthetic hybrid peptide
  MOD_RES (5)..(5): Ava
LRMKXYVEQVAQYK

SEQ ID NO: 150 - protein, 26 aa, Artificial Sequence
  Description of Artificial Sequence: Synthetic hybrid peptide
  MOD_RES (5)..(5): Ava
LRMKXYVEQVAQYKALPVVLENARIL

SEQ ID NO: 151 - protein, 14 aa, Artificial Sequence
  Description of Artificial Sequence: Synthetic hybrid peptide
  MOD_RES (5)..(5): Ava
LRMKXICPAVKRDV

SEQ ID NO: 152 - protein, 14 aa, Artificial Sequence
  Description of Artificial Sequence: Synthetic hybrid peptide
  MOD_RES (5)..(5): Ava
LRMKXVKRDVDLFL

SEQ ID NO: 153 - protein, 14 aa, Artificial Sequence
  Description of Artificial Sequence: Synthetic hybrid peptide
  MOD_RES (5)..(5): Ava
LRMKXLFLTGTPDE

SEQ ID NO: 154 - protein, 24 aa, Artificial Sequence
  Description of Artificial Sequence: Synthetic hybrid peptide
  MOD_RES (5)..(5): Ava
LRMKXICPAVKRDVDLFLTGTPDE

SEQ ID NO: 155 - protein, 14 aa, Artificial Sequence
  Description of Artificial Sequence: Synthetic hybrid peptide
  MOD_RES (5)..(5): Ava
LRMKXLSLLDKIYT

SEQ ID NO: 156 - protein, 14 aa, Artificial Sequence
  Description of Artificial Sequence: Synthetic hybrid peptide
  MOD_RES (5)..(5): Ava
LRMKXLDKIYTSPL

SEQ ID NO: 157 - protein, 17 aa, Artificial Sequence
  Description of Artificial Sequence: Synthetic hybrid peptide
  MOD_RES (5)..(5): Ava
LRMKXLSLLDKIYTSPL

SEQ ID NO: 158 - protein, 17 aa, Felis catus
EICPAVKRDVDLFLTGT

SEQ ID NO: 159 - protein, 17 aa, Felis catus
LFLTGTPDEYVEQVAQY

SEQ ID NO: 160 - protein, 16 aa, Felis catus
EQVAQYKALPVVLENA

SEQ ID NO: 161 - protein, 17 aa, Felis catus
KALPVVLENARILKNCV

SEQ ID NO: 162 - protein, 17 aa, Felis catus
RILKNCVDAKMTEEDKE

SEQ ID NO: 163 - protein, 16 aa, Felis catus
KMTEEDKENALSLLDK

SEQ ID NO: 164 - protein, 16 aa, Felis catus
KENALSVLDKIYTSPL

SEQ ID NO: 165 - protein, 22 aa, Artificial Sequence
  Description of Artificial Sequence: Synthetic hybrid peptide
  MOD_RES (5)..(5): Ava
LRMKXLFLTGTPDEYVEQVAQY

SEQ ID NO: 166 - protein, 21 aa, Artificial Sequence
  Description of Artificial Sequence: Synthetic hybrid peptide
  MOD_RES (5)..(5): Ava
LRMKXEQVAQYKALPVVLENA

SEQ ID NO: 167 - protein, 22 aa, Artificial Sequence
  Description of Artificial Sequence: Synthetic hybrid peptide
  MOD_RES (5)..(5): Ava
LRMKXKALPVVLENARILKNCV

SEQ ID NO: 168 - protein, 22 aa, Artificial Sequence
  Description of Artificial Sequence: Synthetic hybrid peptide
  MOD_RES (5)..(5): Ava
LRMKXRILKNCVDAKMTEEDKE

SEQ ID NO: 169 - protein, 37 aa, Artificial Sequence
  Description of Artificial Sequence: Synthetic hybrid peptide
  MOD_RES (5)..(5): Ava
LRMKXQVAQYKALPVVLENARILKNCVDAKMTEEDKE

SEQ ID NO: 170 - protein, 9 aa, Felis catus
LLVTQALGV

SEQ ID NO: 171 - protein, 9 aa, Felis catus
LLLDLSLTK

SEQ ID NO: 172 - protein, 9 aa, Felis catus
LVMTTISSS

SEQ ID NO: 173 - protein, 9 aa, Felis catus
VKMAETCPI

SEQ ID NO: 174 - protein, 9 aa, Felis catus
LVLALLVTQ

SEQ ID NO: 175 - protein, 9 aa, Felis catus
LLVLALLVT

SEQ ID NO: 176 - protein, 14 aa, Artificial Sequence
  Description of Artificial Sequence: Synthetic hybrid peptide
  MOD_RES (5)..(5): Ava
LRMKXLLVTQALGV

SEQ ID NO: 177 - protein, 14 aa, Artificial Sequence
  Description of Artificial Sequence: Synthetic hybrid peptide
  MOD_RES (5)..(5): Ava
LRMKXLVLALLVTQ

SEQ ID NO: 178 - protein, 14 aa, Artificial Sequence
  Description of Artificial Sequence: Synthetic hybrid peptide
  MOD_RES (5)..(5): Ava
LRMKXLLVLALLVT

SEQ ID NO: 179 - protein, 19 aa, Artificial Sequence
  Description of Artificial Sequence: Synthetic hybrid peptide
  MOD_RES (5)..(5): Ava
LRMKXLLVLALLVTQALGV

SEQ ID NO: 180 - protein, 14 aa, Artificial Sequence
  Description of Artificial Sequence: Synthetic hybrid peptide
  MOD_RES (5)..(5): Ava
LRMKXVKMAETCPI

SEQ ID NO: 181 - protein, 14 aa, Artificial Sequence
  Description of Artificial Sequence: Synthetic hybrid peptide
  MOD_RES (5)..(5): Ava
LRMKXLLLDLSLTK

SEQ ID NO: 182 - protein, 14 aa, Artificial Sequence
  Description of Artificial Sequence: Synthetic hybrid peptide
  MOD_RES (5)..(5): Ava
LRMKXLVMTTISSS

SEQ ID NO: 183 - protein, 16 aa, Felis catus
LTKVNATEPERTAMKK

SEQ ID NO: 184 - protein, 16 aa, Felis catus
TAMKKIQDCYVENGLI

SEQ ID NO: 185 - protein, 16 aa, Felis catus
CYVENGLISRVLDGLV

SEQ ID NO: 186 - protein, 16 aa, Felis catus
ISSSKDCMGEAVQNTV

SEQ ID NO: 187 - protein, 16 aa, Felis catus
AVQNTVEDLKLNTLGR

SEQ ID NO: 188 - protein, 21 aa, Artificial Sequence
  Description of Artificial Sequence: Synthetic hybrid peptide
  MOD_RES (5)..(5): Ava
LRMKXLTKVNATEPERTAMKK

SEQ ID NO: 189 - protein, 21 aa, Artificial Sequence
  Description of Artificial Sequence: Synthetic hybrid peptide
  MOD_RES (5)..(5): Ava
LRMKXTAMKKIQDCYVENGLI

SEQ ID NO: 190 - protein, 21 aa, Artificial Sequence
  Description of Artificial Sequence: Synthetic hybrid peptide
  MOD_RES (5)..(5): Ava
LRMKXCYVENGLISRVLDGLV

SEQ ID NO: 191 - protein, 21 aa, Artificial Sequence
  Description of Artificial Sequence: Synthetic hybrid peptide
  MOD_RES (5)..(5): Ava
LRMKXISSSKDCMGEAVQNTV

SEQ ID NO: 192 - protein, 29 aa, Artificial Sequence
  Description of Artificial Sequence: Synthetic hybrid peptide
  MOD_RES (5)..(5): Ava
LRMKXTAMKKIQDCYVENGLISRVLDGLV

SEQ ID NO: 193 - protein, 263 aa, Phleum pratense
MASSSSVLLVVVLFAVFLGSAYGIPKVPPGPNITATYGDKWLDAKSTWYGKPTGAGPKDNGGACGYKDVDKPPFSGMTGCGNTPIFKSGRGCGSCFEIKCTKPEACSGEPVVVHITDDNEEPIAPYHFDLSGHAFGAMAKKGDEQKLRSAGELELQFRRVKCKYPEGTKVTFHVEKGSNPNYLALLVKYVNGDGDVVAVDIKEKGKDKWIELKESWGAIWRIDTPDKLTGPFTVRYTTEGGTKTEAEDVIPEGWKADTSYESK

SEQ ID NO: 194 - protein, 9 aa, Phleum pratense
MASSSSVLL

SEQ ID NO: 195 - protein, 9 aa, Phleum pratense
WRIDTPDKL

SEQ ID NO: 196 - protein, 9 aa, Phleum pratense
VVVLFAVFL

SEQ ID NO: 197 - protein, 8 aa, Phleum pratense
VVLFAVLG

SEQ ID NO: 198 - protein, 9 aa, Phleum pratense
VLLVVVLFA

SEQ ID NO: 199 - protein, 9 aa, Phleum pratense
FEIKCTKPE

SEQ ID NO: 200 - protein, 9 aa, Phleum pratense
VFLGSAYGI

SEQ ID NO: 201 - protein, 9 aa, Phleum pratense
LVKYVNGDG

SEQ ID NO: 202 - protein, 9 aa, Phleum pratense
LLVKYVNGD

SEQ ID NO: 203 - protein, 14 aa, Artificial Sequence
  Description of Artificial Sequence: Synthetic hybrid peptide
  MOD_RES (5)..(5): Ava
LRMKXMASSSSVLL

SEQ ID NO: 204 - protein, 14 aa, Artificial Sequence
  Description of Artificial Sequence: Synthetic hybrid peptide
  MOD_RES (5)..(5): Ava
LRMKXVLLVVVLFA

SEQ ID NO: 205 - protein, 14 aa, Artificial Sequence
  Description of Artificial Sequence: Synthetic hybrid peptide
  MOD_RES (5)..(5): Ava
LRMKXVVVLFAVFL

SEQ ID NO: 206 - protein, 14 aa, Artificial Sequence
  Description of Artificial Sequence: Synthetic hybrid peptide
  MOD_RES (5)..(5): Ava
LRMKXVVLFAVFLG

SEQ ID NO: 207 - protein, 24 aa, Artificial Sequence
  Description of Artificial Sequence: Synthetic hybrid peptide
  MOD_RES (5)..(5): Ava
LRMKXMASSSSVLLVVVLFAVFLG

SEQ ID NO: 208 - protein, 14 aa, Artificial Sequence
  Description of Artificial Sequence: Synthetic hybrid peptide
  MOD_RES (5)..(5): Ava
LRMKXWRIDTPDKL

SEQ ID NO: 209 - protein, 14 aa, Artificial Sequence
  Description of Artificial Sequence: Synthetic hybrid peptide
  MOD_RES (5)..(5): Ava
LRMKXFEIKCTKPE

SEQ ID NO: 210 - protein, 14 aa, Artificial Sequence
  Description of Artificial Sequence: Synthetic hybrid peptide
  MOD_RES (5)..(5): Ava
LRMKXVFLGSAYGI

SEQ ID NO: 211 - protein, 14 aa, Artificial Sequence
  Description of Artificial Sequence: Synthetic hybrid peptide
  MOD_RES (5)..(5): Ava
LRMKXLLVKYVNGD

SEQ ID NO: 212 - protein, 14 aa, Artificial Sequence
  Description of Artificial Sequence: Synthetic hybrid peptide
  MOD_RES (5)..(5): Ava
LRMKXLVKYVNGDG

SEQ ID NO: 213 - protein, 15 aa, Artificial Sequence
  Description of Artificial Sequence: Synthetic hybrid peptide
  MOD_RES (5)..(5): Ava
LRMKXLLVKYVNGDG

SEQ ID NO: 214 - protein, 12 aa, Phleum pratense
FEIKCTKPEACS

SEQ ID NO: 215 - protein, 12 aa, Phleum pratense
IAPYHFDLSGHA

SEQ ID NO: 216 - protein, 17 aa, Artificial Sequence
  Description of Artificial Sequence: Synthetic hybrid peptide
  MOD_RES (5)..(5): Ava
LRMKXFEIKCTKPEACS

SEQ ID NO: 217 - protein, 17 aa, Artificial Sequence
  Description of Artificial Sequence: Synthetic hybrid peptide
  MOD_RES (5)..(5): Ava
LRMKXIAPYHFDLSGHA

SEQ ID NO: 218 - protein, 30 aa, Phleum pratense
IPKVPPGPNITATYGDKWLDAKSTWYGKPT

SEQ ID NO: 219 - protein, 27 aa, Phleum pratense
GYKDVDKPPFSGMTGCGNTPIFKSGRG

SEQ ID NO: 220 - protein, 31 aa, Phleum pratense
EPVVVHITDDNEEPIAPYHFDLSGHAFGAMA

SEQ ID NO: 221 - protein, 27 aa, Phleum pratense
HVEKGSNPNYLALLVKYVNGDGDVVAV

SEQ ID NO: 222 - protein, 29 aa, Phleum pratense
RYTTEGGTKTEAEDVIPEGWKADTSYESK

SEQ ID NO: 223 - protein, 49 aa, Artificial Sequence
  Description of Artificial Sequence: Synthetic hybrid peptide
  MOD_RES (5)..(5): Ava
LRMKXFEIKCTKPEACSGEPVVVHITDDNEEPIAPYHFDLSGHAFGAMA

SEQ ID NO: 224 - protein, 286 aa, Phleum pratense
ADLGYGPATPAAPAAGYTPATPAAPAGADAAGKATTEEQKLIEKINAGFKAALAGAGVQPADKYRTFVATFGPASNKAFAEGLSGEPKGAAESSSKAALTSKLDAAYKLAYKTAEGATPEAKYDAYVATLSEALRIIAGTLEVHAVKPAAEEVKVIPAGELQVIEKVDAAFKVAATAANAAPANDKFTVFEAAFNDEIKASTGGAYESYKFIPALEAAVKQAYAATVATAPEVKYTVFETALKKAITAMSEAQKAAKPAAAATATATAAVGAATGAATAATGGYKV

SEQ ID NO: 225 - protein, 9 aa, Phleum pratense
YVATLSEAL

SEQ ID NO: 226 - protein, 9 aa, Phleum pratense
VKVIPAGEL

SEQ ID NO: 227 - protein, 9 aa, Phleum pratense
LRIIAGTLE

SEQ ID NO: 228 - protein, 9 aa, Phleum pratense
YKFIPALEA

SEQ ID NO: 229 - protein, 9 aa, Phleum pratense
YESYKFIPA

SEQ ID NO: 230 - protein, 9 aa, Phleum pratense
FKVAATAAN

SEQ ID NO: 231 - protein, 9 aa, Phleum pratense
YRTFVATFG

SEQ ID NO: 232 - protein, 12 aa, Phleum pratense
YKFIPALEAAVK

SEQ ID NO: 233 - protein, 12 aa, Phleum pratense
LQVIEKVDAAFK

SEQ ID NO: 234 - protein, 12 aa, Phleum pratense
YKCIPSLEAAVK

SEQ ID NO: 235 - protein, 12 aa, Phleum pratense
LQIIDKIDAAFK

SEQ ID NO: 236 - protein, 14 aa, Artificial Sequence
  Description of Artificial Sequence: Synthetic hybrid peptide
  MOD_RES (5)..(5): Ava
LRMKXYVATLSEAL

SEQ ID NO: 237 - protein, 14 aa, Artificial Sequence
  Description of Artificial Sequence: Synthetic hybrid peptide
  MOD_RES (5)..(5): Ava
LRMKXVKVIPAGEL

SEQ ID NO: 238 - protein, 14 aa, Artificial Sequence
  Description of Artificial Sequence: Synthetic hybrid peptide
  MOD_RES (5)..(5): Ava
LRMKXLRIIAGTLE

SEQ ID NO: 239 - protein, 14 aa, Artificial Sequence
  Description of Artificial Sequence: Synthetic hybrid peptide
  MOD_RES (5)..(5): Ava
LRMKXYRTFVATFG

SEQ ID NO: 240 - protein, 14 aa, Artificial Sequence
  Description of Artificial Sequence: Synthetic hybrid peptide
  MOD_RES (5)..(5): Ava
LRMKXYKFIPALEA

SEQ ID NO: 241 - protein, 14 aa, Artificial Sequence
  Description of Artificial Sequence: Synthetic hybrid peptide
  MOD_RES (5)..(5): Ava
LRMKXYESYKFIPA

SEQ ID NO: 242 - protein, 17 aa, Artificial Sequence
  Description of Artificial Sequence: Synthetic hybrid peptide
  MOD_RES (5)..(5): Ava
LRMKXYESYKFIPALEA

SEQ ID NO: 243 - protein, 17 aa, Artificial Sequence
  Description of Artificial Sequence: Synthetic hybrid peptide
  MOD_RES (5)..(5): Ava
LRMKXLQVIEKVDAAFK

SEQ ID NO: 244 - protein, 14 aa, Artificial Sequence
  Description of Artificial Sequence: Synthetic hybrid peptide
  MOD_RES (5)..(5): Ava
LRMKXFKVAATAAN

SEQ ID NO: 245 - protein, 24 aa, Artificial Sequence
  Description of Artificial Sequence: Synthetic hybrid peptide
  MOD_RES (5)..(5): Ava
LRMKXLQVIEKVDAAFKVAATAAN

SEQ ID NO: 246 - protein, 162 aa, Apis mellifera
GSLFLLLLSTSHGWQIRDRIGDNELEERIIYPGTLWCGHGNKSSGPNELGRFKHTDACCRTHDMCPDVMSAGESKHGLTNTASHTRLSCDCDDKFYDCLKNSADTISSYFVGKMYFNLIDTKCYKLEHPVTGCGERTEGRCLHYTVDKSKPKVYQWFDLRKY

SEQ ID NO: 247 - protein, 9 aa, Apis mellifera
WQIRDRIGD

SEQ ID NO: 248 - protein, 9 aa, Apis mellifera
FLLLLSTSH

SEQ ID NO: 249 - protein, 9 aa, Apis mellifera
FVGKMYFNL

SEQ ID NO: 250 - protein, 9 aa, Apis mellifera
LIDTKCYKL

SEQ ID NO: 251 - protein, 9 aa, Apis mellifera
LLLSTSHGW

SEQ ID NO: 252 - protein, 9 aa, Apis mellifera
FNLIDTKCY

SEQ ID NO: 253 - protein, 9 aa, Apis mellifera
LLLLSTSHG

SEQ ID NO: 254 - protein, 9 aa, Apis mellifera
FKHTDACCR

SEQ ID NO: 255 - protein, 9 aa, Apis mellifera
YKLEHPVTG

SEQ ID NO: 256 - protein, 13 aa, Apis mellifera
KMYFNLIDTKCYK

SEQ ID NO: 257 - protein, 13 aa, Apis mellifera
KCYKLEHPVTGCG

SEQ ID NO: 258 - protein, 13 aa, ;Apis mellifera
YFVGKMYFNLIDT

SEQ ID NO: 259 - protein, 12 aa, Apis mellifera
CLHYTVDKSKPK

SEQ ID NO: 260 - protein, 18 aa, Apis mellifera
ESKHGLTNTASHTRLSCD

SEQ ID NO: 261 - protein, 14 aa, Artificial Sequence
  Description of Artificial Sequence: Synthetic hybrid peptide
  MOD_RES (5)..(5): Ava
LRMKXWQIRDRIGD

SEQ ID NO: 262 - protein, 14 aa, Artificial Sequence
  Description of Artificial Sequence: Synthetic hybrid peptide
  MOD_RES (5)..(5): Ava
LRMKXFKHTDACCR

SEQ ID NO: 263 - protein, 14 aa, Artificial Sequence
  Description of Artificial Sequence: Synthetic hybrid peptide
  MOD_RES (5)..(5): Ava
LRMKXFLLLLSTSH

SEQ ID NO: 264 - protein, 14 aa, Artificial Sequence
  Description of Artificial Sequence: Synthetic hybrid peptide
  MOD_RES (5)..(5): Ava
LRMKXLLLLSTSHG

SEQ ID NO: 265 - protein, 14 aa, Artificial Sequence
  Description of Artificial Sequence: Synthetic hybrid peptide
  MOD_RES (5)..(5): Ava
LRMKXLLLSTSHGW

SEQ ID NO: 266 - protein, 16 aa, Artificial Sequence
  Description of Artificial Sequence: Synthetic hybrid peptide
  MOD_RES (5)..(5): Ava
LRMKXFLLLLSTSHGW

SEQ ID NO: 267 - protein, 14 aa, Artificial Sequence
  Description of Artificial Sequence: Synthetic hybrid peptide
  MOD_RES (5)..(5): Ava
LRMKXFVGKMYFNL

SEQ ID NO: 268 - protein, 14 aa, Artificial Sequence
  Description of Artificial Sequence: Synthetic hybrid peptide
  MOD_RES (5)..(5): Ava
LRMKXFNLIDTKCY

SEQ ID NO: 269 - protein, 14 aa, Artificial Sequence
  Description of Artificial Sequence: Synthetic hybrid peptide
  MOD_RES (5)..(5): Ava
LRMKXLIDTKCYKL

SEQ ID NO: 270 - protein, 22 aa, Artificial Sequence
  Description of Artificial Sequence: Synthetic hybrid peptide
  MOD_RES (5)..(5): Ava
LRMKXFVGKMYFNLIDTKCYKL

SEQ ID NO: 271 - protein, 204 aa, Blattella germanica
MAPSYKLTYCPVKALGEPIRFLLSYGEKDFEDYRFQEGDWPNLKPSMPFGKTPVLEIDGKQTHQSVAISRYLGKQFGLSGKDDWENLEIDMIVDTISDFRAAIANYHYDADENSKQKKWDPLKKETIPYYTKKFDEVVKANGGYLAAGKLTWADFYFVAILDYLNHMAKEDLVANQPNLKALREKVLGLPAIKAWVAKRPPTDL

SEQ ID NO: 272 - protein, 9 aa, Blattella germanica
FGKTPVLEI

SEQ ID NO: 273 - protein, 9 aa, Blattella germanica
WVAKRPPTD

SEQ ID NO: 274 - protein, 9 aa, Blattella germanica
MIVDTISDF

SEQ ID NO: 275 - protein, 9 aa, Blattella germanica
FYFVAILDY

SEQ ID NO: 276 - protein, 9 aa, Blattella germanica
IRFLLSYGE

SEQ ID NO: 277 - protein, 9 aa, Blattella germanica
LEIDGKQTH

SEQ ID NO: 278 - protein, 9 aa, Blattella germanica
FRAAIANYH

SEQ ID NO: 279 - protein, 20 aa, Blattella germanica
IVDTISDFRAAIANYHYDAD

SEQ ID NO: 280 - protein, 20 aa, Blattella germanica
DYLNHMAKEDLVANQPNLKA

SEQ ID NO: 281 - protein, 9 aa, Homo sapiens
IPQQHTQVL

SEQ ID NO: 282 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 283 - protein, 9 aa, Homo sapiens
YRPGVNLSL

SEQ ID NO: 284 - protein, 9 aa, Homo sapiens
WVNGQSLPV

SEQ ID NO: 285 - protein, 9 aa, Homo sapiens
WVNNQSLPV

SEQ ID NO: 286 - protein, 9 aa, Homo sapiens
WRINGIPQQ

SEQ ID NO: 287 - protein, 9 aa, Homo sapiens
YRSGENLNL

SEQ ID NO: 288 - protein, 9 aa, Homo sapiens
LLLVHNLPQ

SEQ ID NO: 289 - protein, 9 aa, Homo sapiens
WLIDGNIQQ

SEQ ID NO: 290 - protein, 9 aa, Homo sapiens
YGPDTPIIS

SEQ ID NO: 291 - protein, 9 aa, Homo sapiens
FYTLHVIKS

SEQ ID NO: 292 - protein, 9 aa, Homo sapiens
IIGYVIGTQ

SEQ ID NO: 293 - protein, 14 aa, Artificial Sequence
  Description of Artificial Sequence: Synthetic hybrid peptide
  MOD_RES (5)..(5): Ava
LRMKXWVNNQSLPV

SEQ ID NO: 294 - protein, 14 aa, Artificial Sequence
  Description of Artificial Sequence: Synthetic hybrid peptide
  MOD_RES (5)..(5): Ava
LRMKXYRPGVNLSL

SEQ ID NO: 295 - protein, 14 aa, Artificial Sequence
  Description of Artificial Sequence: Synthetic hybrid peptide
  MOD_RES (5)..(5): Ava
LRMKXWRINGIPQQ

SEQ ID NO: 296 - protein, 14 aa, Artificial Sequence
  Description of Artificial Sequence: Synthetic hybrid peptide
  MOD_RES (5)..(5): Ava
LRMKXYRSGENLNL

SEQ ID NO: 297 - protein, 9 aa, Homo sapiens
HLFGYSWYK

SEQ ID NO: 298 - protein, 9 aa, Homo sapiens
TYYRPGVNL

SEQ ID NO: 299 - protein, 9 aa, Homo sapiens
TYACFVSNL

SEQ ID NO: 300 - protein, 9 aa, Homo sapiens
IMIGVLVGV

SEQ ID NO: 301 - protein, 9 aa, Homo sapiens
YLSGANLNL

SEQ ID NO: 302 - protein, 9 aa, Homo sapiens
IMIGVLVGV

SEQ ID NO: 303 - protein, 9 aa, Homo sapiens
LMTFWNPPV

SEQ ID NO: 304 - protein, 9 aa, Homo sapiens
YLSGANLNL

SEQ ID NO: 305 - protein, 10 aa, Homo sapiens
QYSWFVNGTF

SEQ ID NO: 306 - protein, 9 aa, Homo sapiens
TYACFVSNL

SEQ ID NO: 307 - protein, 8 aa, Homo sapiens
HLFYSWYK

SEQ ID NO: 308 - protein, 9 aa, Artificial Sequence
  Description of Artificial Sequence: Synthetic hybrid peptide
LLTFWNPPV

SEQ ID NO: 309 - protein, 9 aa, Unknown
  Description of Unknown Organism: Wild type peptide
LLTFWNPPT

SEQ ID NO: 310 - protein, 23 aa, Artificial Sequence
  Description of Artificial Sequence: Synthetic hybrid peptide
  MOD_RES (5)..(5): Ava
LRMKXWVNNQSLPVIMIGVLVGV

SEQ ID NO: 311 - protein, 16 aa, Artificial Sequence
  Description of Artificial Sequence: Synthetic hybrid peptide
  MOD_RES (5)..(5): Ava
LRMKXTYYRPGVNLSL

SEQ ID NO: 312 - protein, 24 aa, Artificial Sequence
  Description of Artificial Sequence: Synthetic hybrid peptide
  MOD_RES (5)..(5): Ava
LRMKXYRSGENLNLQYSWFVNGTF

SEQ ID NO: 313 - protein, 22 aa, Artificial Sequence
  Description of Artificial Sequence: Synthetic hybrid peptide
  MOD_RES (5)..(5): Ava
LRMKXLLLVHNLPQHLFYSWYK

SEQ ID NO: 314 - protein, 1890 aa, Homo sapiens
RVDPIGPGLDRERLYWELSQLTNSITELGPYTLDRDSLYVNGFNPWSSVPTTSTPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTATGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTIINLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYPNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 315 - protein, 9 aa, Homo sapiens
FRFCLVTNL

SEQ ID NO: 316 - protein, 9 aa, Homo sapiens
VLFTLNFTI

SEQ ID NO: 317 - protein, 9 aa, Homo sapiens
ILFTLNFTI

SEQ ID NO: 318 - protein, 9 aa, Homo sapiens
LRLDPTGPG

SEQ ID NO: 319 - protein, 9 aa, Homo sapiens
LVLFTLNFT

SEQ ID NO: 320 - protein, 9 aa, Homo sapiens
LVLFTINFT

SEQ ID NO: 321 - protein, 9 aa, Homo sapiens
IVNLGTSGI

SEQ ID NO: 322 - protein, 9 aa, Homo sapiens
LRYMADMGQ

SEQ ID NO: 323 - protein, 9 aa, Homo sapiens
LRYEENMQH

SEQ ID NO: 324 - protein, 9 aa, Homo sapiens
LRYEENMHH

SEQ ID NO: 325 - protein, 9 aa, Homo sapiens
VFLDKTLNA

SEQ ID NO: 326 - protein, 9 aa, Homo sapiens
LLILFTLNF

SEQ ID NO: 327 - protein, 9 aa, Homo sapiens
YRPDPKSPG

SEQ ID NO: 328 - protein, 9 aa, Homo sapiens
LVPFTLNFT

SEQ ID NO: 329 - protein, 9 aa, Homo sapiens
LRPLFKNTS

SEQ ID NO: 330 - protein, 9 aa, Homo sapiens
LRYEENMWP

SEQ ID NO: 331 - protein, 9 aa, Homo sapiens
LVTNLTMDS

SEQ ID NO: 332 - protein, 9 aa, Homo sapiens
FVPITSTPG

SEQ ID NO: 333 - protein, 9 aa, Homo sapiens
LRPLFKNTS

SEQ ID NO: 334 - protein, 9 aa, Homo sapiens
LRPVFKNTS

SEQ ID NO: 335 - protein, 9 aa, Homo sapiens
YHPDPVGPG

SEQ ID NO: 336 - protein, 14 aa, Artificial Sequence
  Description of Artificial Sequence: Synthetic hybrid peptide
  MOD_RES (5)..(5): Ava
LRMKXVLFTLNFTI

SEQ ID NO: 337 - protein, 14 aa, Artificial Sequence
  Description of Artificial Sequence: Synthetic hybrid peptide
  MOD_RES (5)..(5): Ava
LRMKXILFTLNFTI

SEQ ID NO: 338 - protein, 14 aa, Artificial Sequence
  Description of Artificial Sequence: Synthetic hybrid peptide
  MOD_RES (5)..(5): Ava
LRMKXLVLFTINFT

SEQ ID NO: 339 - protein, 14 aa, Artificial Sequence
  Description of Artificial Sequence: Synthetic hybrid peptide
  MOD_RES (5)..(5): Ava
LRMKXLRYEENMQH

SEQ ID NO: 340 - protein, 14 aa, Artificial Sequence
  Description of Artificial Sequence: Synthetic hybrid peptide
  MOD_RES (5)..(5): Ava
LRMKXLRYEENMHH

SEQ ID NO: 341 - protein, 14 aa, Artificial Sequence
  Description of Artificial Sequence: Synthetic hybrid peptide
  MOD_RES (5)..(5): Ava
LRMKXLRYEENMWP

SEQ ID NO: 342 - protein, 14 aa, Artificial Sequence
  Description of Artificial Sequence: Synthetic hybrid peptide
  MOD_RES (5)..(5): Ava
LRMKXFRFCLVTNL

SEQ ID NO: 343 - protein, 14 aa, Artificial Sequence
  Description of Artificial Sequence: Synthetic hybrid peptide
  MOD_RES (5)..(5): Ava
LRMKXLVTNLTMDS

SEQ ID NO: 344 - protein, 18 aa, Artificial Sequence
  Description of Artificial Sequence: Synthetic hybrid peptide
  MOD_RES (5)..(5): Ava
LRMKXFRFCLVTNLTMDS

SEQ ID NO: 345 - protein, 9 aa, Homo sapiens
WLGSTYQLV

SEQ ID NO: 346 - protein, 9 aa, Homo sapiens
VLFTLNFTI

SEQ ID NO: 347 - protein, 9 aa, Homo sapiens
ILFTLNFTI

SEQ ID NO: 348 - protein, 9 aa, Homo sapiens
VLFTINFTI

SEQ ID NO: 349 - protein, 9 aa, Homo sapiens
LLDRGSLYV

SEQ ID NO: 350 - protein, 9 aa, Homo sapiens
YLGCQLISL

SEQ ID NO: 351 - protein, 9 aa, Homo sapiens
TLNASFHWL

SEQ ID NO: 352 - protein, 9 aa, Homo sapiens
GVTQLGFYV

SEQ ID NO: 353 - protein, 9 aa, Homo sapiens
GLLGLITCL

SEQ ID NO: 354 - protein, 9 aa, Homo sapiens
KLTRGIIEL

SEQ ID NO: 355 - protein, 14 aa, Artificial Sequence
  Description of Artificial Sequence: Synthetic hybrid peptide
  MOD_RES (5)..(5): Ava
LRMKXFRFCLVTNL

SEQ ID NO: 356 - protein, 15 aa, Artificial Sequence
  Description of Artificial Sequence: Synthetic hybrid peptide
  MOD_RES (5)..(5): Ava
LRMKXLVPFTLNFTI

SEQ ID NO: 357 - protein, 6 aa, Artificial Sequence
  Description of Artificial Sequence: Synthetic 6xHis tag
HHHHHH

SEQ ID NO: 358 - protein, 261 aa, Homo sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 359 - protein, 9 aa, Homo sapiens
WVLTAAHCI

SEQ ID NO: 360 - protein, 9 aa, Homo sapiens
WVPVVFLTL

SEQ ID NO: 361 - protein, 9 aa, Homo sapiens
LRLSEPAEL

SEQ ID NO: 362 - protein, 9 aa, Homo sapiens
IRNKSVILL

SEQ ID NO: 363 - protein, 9 aa, Homo sapiens
LLGRHSLFH

SEQ ID NO: 364 - protein, 9 aa, Homo sapiens
VILLGRHSL

SEQ ID NO: 365 - protein, 9 aa, Homo sapiens
LQGITSWGS

SEQ ID NO: 366 - protein, 16 aa, Homo sapiens
ERPSLYTKVVHYRKWI

SEQ ID NO: 367 - protein, 14 aa, Artificial Sequence
  Description of Artificial Sequence: Synthetic hybrid peptide
  MOD_RES (5)..(5): Ava
LRMKXWVPVVFLTL

SEQ ID NO: 368 - protein, 14 aa, Artificial Sequence
  Description of Artificial Sequence: Synthetic hybrid peptide
  MOD_RES (5)..(5): Ava
LRMKXLRLSEPAEL

SEQ ID NO: 369 - protein, 14 aa, Artificial Sequence
  Description of Artificial Sequence: Synthetic hybrid peptide
  MOD_RES (5)..(5): Ava
LRMKXLQGITSWGS

SEQ ID NO: 370 - protein, 14 aa, Artificial Sequence
  Description of Artificial Sequence: Synthetic hybrid peptide
  MOD_RES (5)..(5): Ava
LRMKXWVLTAAHCI

SEQ ID NO: 371 - protein, 14 aa, Artificial Sequence
  Description of Artificial Sequence: Synthetic hybrid peptide
  MOD_RES (5)..(5): Ava
LRMKXIRNKSVILL

SEQ ID NO: 372 - protein, 14 aa, Artificial Sequence
  Description of Artificial Sequence: Synthetic hybrid peptide
  MOD_RES (5)..(5): Ava
LRMKXVILLGRHSL

SEQ ID NO: 373 - protein, 14 aa, Artificial Sequence
  Description of Artificial Sequence: Synthetic hybrid peptide
  MOD_RES (5)..(5): Ava
LRMKXLLGRHSLFH

SEQ ID NO: 374 - protein, 29 aa, Artificial Sequence
  Description of Artificial Sequence: Synthetic hybrid peptide
  MOD_RES (5)..(5): Ava
LRMKXWVLTAAHCIRNKSVILLGRHSLFH

SEQ ID NO: 375 - protein, 8 aa, Homo sapiens
GRAVCGVL

SEQ ID NO: 376 - protein, 9 aa, Homo sapiens
IRNKSVILL

SEQ ID NO: 377 - protein, 9 aa, Homo sapiens
LRLSEPAEL

SEQ ID NO: 378 - protein, 9 aa, Homo sapiens
APLILSRIV

SEQ ID NO: 379 - protein, 9 aa, Homo sapiens
FLTLSVTWI

SEQ ID NO: 380 - protein, 9 aa, Homo sapiens
YRKWIKDTI

SEQ ID NO: 381 - protein, 10 aa, Homo sapiens
HPQKVTKFML

SEQ ID NO: 382 - protein, 19 aa, Artificial Sequence
  Description of Artificial Sequence: Synthetic hybrid peptide
  MOD_RES (5)..(5): Ava
LRMKXWVPVVFLTLSVTWI

SEQ ID NO: 383 - protein, 14 aa, Artificial Sequence
  Description of Artificial Sequence: Synthetic hybrid peptide
  MOD_RES (5)..(5): Ava
LRMKXIRNKSVILL

SEQ ID NO: 384 - protein, 14 aa, Artificial Sequence
  Description of Artificial Sequence: Synthetic hybrid peptide
  MOD_RES (5)..(5): Ava
LRMKXLRLSEPAEL

SEQ ID NO: 385 - protein, 660 aa, Homo sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 386 - protein, 9 aa, Homo sapiens
VYVWKTWGQ

SEQ ID NO: 387 - protein, 8 aa, Homo sapiens
WVETTREL

SEQ ID NO: 388 - protein, 9 aa, Homo sapiens
LYRYGSFSV

SEQ ID NO: 389 - protein, 9 aa, Homo sapiens
VVLQAAIPL

SEQ ID NO: 390 - protein, 9 aa, Homo sapiens
LVLHQILKG

SEQ ID NO: 391 - protein, 9 aa, Homo sapiens
VPLIVGILL

SEQ ID NO: 392 - protein, 9 aa, Homo sapiens
VGILLVLMA

SEQ ID NO: 393 - protein, 9 aa, Homo sapiens
VLMAVVLAS

SEQ ID NO: 394 - protein, 9 aa, Homo sapiens
LVLMAVVLA

SEQ ID NO: 395 - protein, 9 aa, Homo sapiens
LVLKRCLLH

SEQ ID NO: 396 - protein, 9 aa, Homo sapiens
IYRRRLMKQ

SEQ ID NO: 397 - protein, 9 aa, Homo sapiens
YRRRLMKQD

SEQ ID NO: 398 - protein, 9 aa, Homo sapiens
LYPEWTEAQ

SEQ ID NO: 399 - protein, 16 aa, Homo sapiens
WNRQLYPEWTEAQRLD

SEQ ID NO: 400 - protein, 19 aa, Homo sapiens
IYRRRLMKQDFSVPQLPHS

SEQ ID NO: 401 - protein, 13 aa, Homo sapiens
SLAVVSTQLIMPG

SEQ ID NO: 402 - protein, 15 aa, Homo sapiens
GRAMLGTHTMEVTVY

SEQ ID NO: 403 - protein, 16 aa, Homo sapiens
GPTLIGANASFSIALN

SEQ ID NO: 404 - protein, 24 aa, Artificial Sequence
  Description of Artificial Sequence: Synthetic hybrid peptide
  MOD_RES (5)..(5): Ava
LRMKXIYRRRLMKQDFSVPQLPHS

SEQ ID NO: 405 - protein, 14 aa, Artificial Sequence
  Description of Artificial Sequence: Synthetic hybrid peptide
  MOD_RES (5)..(5): Ava
LRMKXLVLKRCLLH

SEQ ID NO: 406 - protein, 14 aa, Artificial Sequence
  Description of Artificial Sequence: Synthetic hybrid peptide
  MOD_RES (5)..(5): Ava
LRMKXVYVWKTWGQ

SEQ ID NO: 407 - protein, 14 aa, Artificial Sequence
  Description of Artificial Sequence: Synthetic hybrid peptide
  MOD_RES (5)..(5): Ava
LRMKXWVETTAREL

SEQ ID NO: 408 - protein, 14 aa, Artificial Sequence
  Description of Artificial Sequence: Synthetic hybrid peptide
  MOD_RES (5)..(5): Ava
LRMKXLYRYGSFSV

SEQ ID NO: 409 - protein, 21 aa, Artificial Sequence
  Description of Artificial Sequence: Synthetic hybrid peptide
  MOD_RES (5)..(5): Ava
LRMKXWNRQLYPEWTEAQRLD

SEQ ID NO: 410 - protein, 14 aa, Artificial Sequence
  Description of Artificial Sequence: Synthetic hybrid peptide
  MOD_RES (5)..(5): Ava
LRMKXLYPEWTEAQ

SEQ ID NO: 411 - protein, 21 aa, Artificial Sequence
  Description of Artificial Sequence: Synthetic hybrid peptide
  MOD_RES (5)..(5): Ava
LRMKXWNRQLYPEWTEAQRLD

SEQ ID NO: 412 - protein, 14 aa, Artificial Sequence
  Description of Artificial Sequence: Synthetic hybrid peptide
  MOD_RES (5)..(5): Ava
LRMKXVPLIVGILL

SEQ ID NO: 413 - protein, 14 aa, Artificial Sequence
  Description of Artificial Sequence: Synthetic hybrid peptide
  MOD_RES (5)..(5): Ava
LRMKXVGILLVLMA

SEQ ID NO: 414 - protein, 14 aa, Artificial Sequence
  Description of Artificial Sequence: Synthetic hybrid peptide
  MOD_RES (5)..(5): Ava
LRMKXVLMAVVLAS

SEQ ID NO: 415 - protein, 23 aa, Artificial Sequence
  Description of Artificial Sequence: Synthetic hybrid peptide
  MOD_RES (5)..(5): Ava
LRMKXVPLIVGILLVLMAVVLAS

SEQ ID NO: 416 - protein, 9 aa, Homo sapiens
RLMKQDFSV

SEQ ID NO: 417 - protein, 9 aa, Homo sapiens
LPKEACMEI

SEQ ID NO: 418 - protein, 9 aa, Homo sapiens
ILLVLMAVV

SEQ ID NO: 419 - protein, 9 aa, Homo sapiens
RYGSFSVTL

SEQ ID NO: 420 - protein, 9 aa, Homo sapiens
KTWGQYWQV

SEQ ID NO: 421 - protein, 9 aa, Homo sapiens
ALLAVGATK

SEQ ID NO: 422 - protein, 9 aa, Homo sapiens
LIYRRRLMK

SEQ ID NO: 423 - protein, 9 aa, Homo sapiens
YLEPGPVTA

SEQ ID NO: 424 - protein, 9 aa, Homo sapiens
ALLAVGATK

SEQ ID NO: 425 - protein, 9 aa, Homo sapiens
ITDQVPFSV

SEQ ID NO: 426 - protein, 9 aa, Homo sapiens
LIYRRRLMK

SEQ ID NO: 427 - protein, 9 aa, Homo sapiens
RLMKQDFSV

SEQ ID NO: 428 - protein, 9 aa, Homo sapiens
RLPRIFCSC

SEQ ID NO: 429 - protein, 9 aa, Homo sapiens
KTWGQYWQV

SEQ ID NO: 430 - protein, 10 aa, Homo sapiens
AMLGTHTMEV

SEQ ID NO: 431 - protein, 10 aa, Homo sapiens
SLADTNSLAV

SEQ ID NO: 432 - protein, 9 aa, Homo sapiens
VSNDGPTLI

SEQ ID NO: 433 - protein, 9 aa, Homo sapiens
ALNFPGSQK

SEQ ID NO: 434 - protein, 23 aa, Artificial Sequence
  Description of Artificial Sequence: Synthetic hybrid peptide
  MOD_RES (5)..(5): Ava
LRMKXLPKEACMEILVLHQILKG

SEQ ID NO: 435 - protein, 23 aa, Artificial Sequence
  Description of Artificial Sequence: Synthetic hybrid peptide
  MOD_RES (5)..(5): Ava
LRMKXALLAVGATKLVLKRCLLH

SEQ ID NO: 436 - protein, 24 aa, Artificial Sequence
  Description of Artificial Sequence: Synthetic hybrid peptide
  MOD_RES (5)..(5): Ava
LRMKXSLADTNSLAVVSTQLIMPG

SEQ ID NO: 437 - protein, 20 aa, Artificial Sequence
  Description of Artificial Sequence: Synthetic hybrid peptide
  MOD_RES (5)..(5): Ava
LRMKXGRAMLGTHTMEVTVY

SEQ ID NO: 438 - protein, 31 aa, Artificial Sequence
  Description of Artificial Sequence: Synthetic hybrid peptide
  MOD_RES (5)..(5): Ava
LRMKXVSNDGPTLIGANASFSIALNFPGSQK

SEQ ID NO: 439 - protein, 25 aa, Artificial Sequence
  Description of Artificial Sequence: Synthetic hybrid peptide
  MOD_RES (5)..(5): Ava
LRMKXLIYRRRLMKQDFSVPQLPHS

SEQ ID NO: 440 - protein, 17 aa, Artificial Sequence
  Description of Artificial Sequence: Synthetic hybrid peptide
  MOD_RES (5)..(5): Ava
LRMKXVYVKTWGQYWQV

SEQ ID NO: 441 - protein, 16 aa, Artificial Sequence
  Description of Artificial Sequence: Synthetic hybrid peptide
  MOD_RES (5)..(5): Ava
LRMKXLYRYGSFSVTL

SEQ ID NO: 442 - protein, 519 aa, Homo sapiens
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVLHSFTDAIFDEWMKRFNPPADAWPQELAPIGHNRMYNMVPFFPPVTNEELFLTSDQLGYSYAIDLPVSVEETPGWPTTLLVVMGTLVALVGLFVLLAFLQYRRLRKGYTPLMETHLSSKRYTEEA

SEQ ID NO: 443 - protein, 9 aa, Homo sapiens
YVITTQHWL

SEQ ID NO: 444 - protein, 9 aa, Homo sapiens
LGYSYAIDL

SEQ ID NO: 445 - protein, 10 aa, Homo sapiens
VRADTRPWSG

SEQ ID NO: 446 - protein, 9 aa, Homo sapiens
LVGLFVLLA

SEQ ID NO: 447 - protein, 9 aa, Homo sapiens
LISRNSRFS

SEQ ID NO: 448 - protein, 9 aa, Homo sapiens
FVVLHSFTD

SEQ ID NO: 449 - protein, 9 aa, Homo sapiens
WHRYHLLCL

SEQ ID NO: 450 - protein, 9 aa, Homo sapiens
LRKGYTPLM

SEQ ID NO: 451 - protein, 9 aa, Homo sapiens
VMSLHNLVH

SEQ ID NO: 452 - protein, 9 aa, Homo sapiens
LVVMGTLVA

SEQ ID NO: 453 - protein, 14 aa, Artificial Sequence
  Description of Artificial Sequence: Synthetic hybrid peptide
  MOD_RES (5)..(5): Ava
LRMKXYVITTQHWL

SEQ ID NO: 454 - protein, 14 aa, Artificial Sequence
  Description of Artificial Sequence: Synthetic hybrid peptide
  MOD_RES (5)..(5): Ava
LRMKXLGYSYAIDL

SEQ ID NO: 455 - protein, 14 aa, Artificial Sequence
  Description of Artificial Sequence: Synthetic hybrid peptide
  MOD_RES (5)..(5): Ava
LRMKXVRADTRPSG

SEQ ID NO: 456 - protein, 9 aa, Homo sapiens
SRFSSWETV

SEQ ID NO: 457 - protein, 9 aa, Homo sapiens
KRFNPPADA

SEQ ID NO: 458 - protein, 9 aa, Homo sapiens
IRDCLSLQK

SEQ ID NO: 459 - protein, 9 aa, Homo sapiens
KRVHPDYVI

SEQ ID NO: 460 - protein, 9 aa, Homo sapiens
NRMYNMVPF

SEQ ID NO: 461 - protein, 9 aa, Homo sapiens
GLFVLLAFL

SEQ ID NO: 462 - protein, 9 aa, Homo sapiens
SVYDFFVWL

SEQ ID NO: 463 - protein, 9 aa, Homo sapiens
LAFLQYRRL

SEQ ID NO: 464 - protein, 9 aa, Homo sapiens
NMVPFFPPV

SEQ ID NO: 465 - protein, 9 aa, Homo sapiens
FVWLHYYSV

SEQ ID NO: 466 - protein, 9 aa, Homo sapiens
SVYDFFVWL

SEQ ID NO: 467 - protein, 9 aa, Homo sapiens
GPGRPYRAI

SEQ ID NO: 468 - protein, 9 aa, Homo sapiens
AARPDDPTL

SEQ ID NO: 469 - protein, 9 aa, Homo sapiens
GFDKADGTL

SEQ ID NO: 470 - protein, 9 aa, Homo sapiens
KRFNPPADA

SEQ ID NO: 471 - protein, 9 aa, Homo sapiens
HYYSVRDTL

SEQ ID NO: 472 - protein, 9 aa, Homo sapiens
LQKFDNPPF

SEQ ID NO: 473 - protein, 9 aa, Homo sapiens
SVYDFFVWL

SEQ ID NO: 474 - protein, 9 aa, Homo sapiens
TLDSQVMSL

SEQ ID NO: 475 - protein, 9 aa, Homo sapiens
SLDDYNHLV

SEQ ID NO: 476 - protein, 9 aa, Homo sapiens
YAIDLPVSV

SEQ ID NO: 477 - protein, 23 aa, Artificial Sequence
  Description of Artificial Sequence: Synthetic hybrid peptide
  MOD_RES (5)..(5): Ava
LRMKXYVITTQHWLSVYDFFVWL

SEQ ID NO: 478 - protein, 18 aa, Artificial Sequence
  Description of Artificial Sequence: Synthetic hybrid peptide
  MOD_RES (5)..(5): Ava
LRMKXLGYSYAIDLPVSV

SEQ ID NO: 479 - protein, 19 aa, Artificial Sequence
  Description of Artificial Sequence: Synthetic hybrid peptide
  MOD_RES (5)..(5): Ava
LRMKXTLDSQVMSLHNLVH

SEQ ID NO: 480 - protein, 10 aa, Homo sapeins
CLLWSFQTSA

SEQ ID NO: 481 - protein, 9 aa, Homo sapeins
IMDQVPSFV

SEQ ID NO: 482 - protein, 9 aa, Homo sapeins
YMDGTMSQV

SEQ ID NO: 483 - protein, 12 aa, Homo sapeins
DAEKSDICTDEY

SEQ ID NO: 484 - protein, 9 aa, Homo sapeins
YLEPGPVTA

SEQ ID NO: 485 - protein, 9 aa, Homo sapeins
YMDGTMSQV

SEQ ID NO: 486 - protein, 9 aa, Homo sapeins
ALLAVGATK

SEQ ID NO: 487 - protein, 529 aa, Homo sapiens [sequence omitted]

SEQ ID NO: 488 - protein, 9 aa, Homo sapiens
LRRHRPLQE

SEQ ID NO: 489 - protein, 9 aa, Homo sapiens
MHYYVSMDA

SEQ ID NO: 490 - protein, 9 aa, Homo sapiens
WLRRHRPLQ

SEQ ID NO: 491 - protein, 9 aa, Homo sapiens
LVRRNIFDL

SEQ ID NO: 492 - protein, 9 aa, Homo sapiens
LHIYMNGTM

SEQ ID NO: 493 - protein, 9 aa, Homo sapiens
IYMNGTMSQ

SEQ ID NO: 494 - protein, 9 aa, Homo sapiens
YVSMDALLG

SEQ ID NO: 495 - protein, 9 aa, Homo sapiens
VIPIGTYGQ

SEQ ID NO: 496 - protein, 9 aa, Homo sapiens
FSFRNTLEG

SEQ ID NO: 497 - protein, 9 aa, Homo sapiens
LLCRHKRKQ

SEQ ID NO: 498 - protein, 9 aa, Homo sapiens
MLLAVLYCL

SEQ ID NO: 499 - protein, 9 aa, Homo sapiens
FNDINIYDL

SEQ ID NO: 500 - protein, 15 aa, Homo sapiens
QNILLSNAPLGPQFP

SEQ ID NO: 501 - protein, 17 aa, Homo sapiens
ALHIYMNGTMSQVQGSA

SEQ ID NO: 502 - protein, 20 aa, Homo sapiens
YGQMKNGSTPMFNDINIYDL

SEQ ID NO: 503 - protein, 20 aa, Artificial Sequence
  Description of Artificial Sequence: Synthetic hybrid peptide
  MOD_RES (5)..(5): Ava
LRMKXQNILLSNAPLGPQFP

SEQ ID NO: 504 - protein, 14 aa, Artificial Sequence
  Description of Artificial Sequence: Synthetic hybrid peptide
  MOD_RES (5)..(5): Ava
LRMKXLVRRNIFDL

SEQ ID NO: 505 - protein, 14 aa, Artificial Sequence
  Description of Artificial Sequence: Synthetic hybrid peptide
  MOD_RES (5)..(5): Ava
LRMKXFSFRNTLEG

SEQ ID NO: 506 - protein, 14 aa, Artificial Sequence
  Description of Artificial Sequence: Synthetic hybrid peptide
  MOD_RES (5)..(5): Ava
LRMKXLLCRHKRKQ

SEQ ID NO: 507 - protein, 22 aa, Artificial Sequence
  Description of Artificial Sequence: Synthetic hybrid peptide
  MOD_RES (5)..(5): Ava
LRMKXALHIYMNGTMSQVQGSA

SEQ ID NO: 508 - protein, 14 aa, Artificial Sequence
  Description of Artificial Sequence: Synthetic hybrid peptide
  MOD_RES (5)..(5): Ava
LRMKXLHIYMNGTM

SEQ ID NO: 509 - protein, 14 aa, Artificial Sequence
  Description of Artificial Sequence: Synthetic hybrid peptide
  MOD_RES (5)..(5): Ava
LRMKXIYMNGTMSQ

SEQ ID NO: 510 - protein, 17 aa, Artificial Sequence
  Description of Artificial Sequence: Synthetic hybrid peptide
  MOD_RES (5)..(5): Ava
LRMKXALHIYMNGTMSQ

SEQ ID NO: 511 - protein, 14 aa, Artificial Sequence
  Description of Artificial Sequence: Synthetic hybrid peptide
  MOD_RES (5)..(5): Ava
LRMKXYVSMDALLG

SEQ ID NO: 512 - protein, 14 aa, Artificial Sequence
  Description of Artificial Sequence: Synthetic hybrid peptide
  MOD_RES (5)..(5): Ava
LRMKXMHYYVSMDA

SEQ ID NO: 513 - protein, 17 aa, Artificial Sequence
  Description of Artificial Sequence: Synthetic hybrid peptide
  MOD_RES (5)..(5): Ava
LRMKXMHYYVSMDALLG

SEQ ID NO: 514 - protein, 14 aa, Artificial Sequence
  Description of Artificial Sequence: Synthetic hybrid peptide
  MOD_RES (5)..(5): Ava
LRMKXVIPIGTYGQ

SEQ ID NO: 515 - protein, 25 aa, Artificial Sequence
  Description of Artificial Sequence: Synthetic hybrid peptide
  MOD_RES (5)..(5): Ava
LRMKXYGQMKNGSTPMFNDINIYDL

SEQ ID NO: 516 - protein, 14 aa, Artificial Sequence
  Description of Artificial Sequence: Synthetic hybrid peptide
  MOD_RES (5)..(5): Ava
LRMKXFNDINIYDL

SEQ ID NO: 517 - protein, 31 aa, Artificial Sequence
  Description of Artificial Sequence: Synthetic hybrid peptide
  MOD_RES (5)..(5): Ava
LRMKXVIPIGTYGQMKNGSTPMFNDINIYDL

SEQ ID NO: 518 - protein, 9 aa, Homo sapiens
KCDICTDEY

SEQ ID NO: 519 - protein, 9 aa, Homo sapiens
YMNGTMSQV

SEQ ID NO: 520 - protein, 9 aa, Homo sapiens
MLLAVLYCL

SEQ ID NO: 521 - protein, 9 aa, Homo sapiens
FLPWHRLFL

SEQ ID NO: 522 - protein, 12 aa, Homo sapiens
DAEKSDICTDEY

SEQ ID NO: 523 - protein, 9 aa, Homo sapiens
YMDGTMSQV

SEQ ID NO: 524 - protein, 11 aa, Homo sapiens
SSDYVIPIGTY

SEQ ID NO: 525 - protein, 32 aa, Artificial Sequence
  Description of Artificial Sequence: Synthetic hybrid peptide
  MOD_RES (5)..(5): Ava
LRMKXDAEKSDICTDEYQNILLSNAPLGPQFP

SEQ ID NO: 526 - protein, 23 aa, Artificial Sequence
  Description of Artificial Sequence: Synthetic hybrid peptide
  MOD_RES (5)..(5): Ava
LRMKXFLPWHRLFLLRRHRPLQE

SEQ ID NO: 527 - protein, 22 aa, Artificial Sequence
  Description of Artificial Sequence: Synthetic hybrid peptide
  MOD_RES (5)..(5): Ava
LRMKXALHIYMNGTMSQVQGSA

SEQ ID NO: 528 - protein, 35 aa, Artificial Sequence
  Description of Artificial Sequence: Synthetic hybrid peptide
  MOD_RES (5)..(5): Ava
LRMKXSSDYVIPIGTYGQMKNGSTPMFNDINIYDL

SEQ ID NO: 529 - protein, 14 aa, Artificial Sequence
  Description of Artificial Sequence: Synthetic hybrid peptide
  MOD_RES (5)..(5): Ava
LRMKXMLLAVLYCL

SEQ ID NO: 530 - protein, 9 aa, Homo sapeins
AAGIGILTV

SEQ ID NO: 531 - protein, 118 aa, Homo sapiens
MPREDAHFIYGYPKKGHGHSYTTAEEAAGIGILTVILGVLLLIGCWYCRRRNGYRALMDKSLHVGTQCALTRRCPQEGFDHRDSKVSLQEKNCEPVVPNAPPAYEKLSAEQSPPPYSP

SEQ ID NO: 532 - protein, 9 aa, Homo sapiens
LTVILGVLL

SEQ ID NO: 533 - protein, 9 aa, Homo sapiens
VILGVLLLI

SEQ ID NO: 534 - protein, 9 aa, Homo sapiens
VVPNAPPAY

SEQ ID NO: 535 - protein, 9 aa, Homo sapiens
IGILTVILG

SEQ ID NO: 536 - protein, 9 aa, Homo sapiens
IYGYPKKGH

SEQ ID NO: 537 - protein, 23 aa, Homo sapiens
RNGYRALMDKSLHVGTQCALTRR

SEQ ID NO: 538 - protein, 14 aa, Artificial Sequence
  Description of Artificial Sequence: Synthetic hybrid peptide
  MOD_RES (5)..(5): Ava
LRMKXVVPNAPPAY

SEQ ID NO: 539 - protein, 14 aa, Artificial Sequence
  Description of Artificial Sequence: Synthetic hybrid peptide
  MOD_RES (5)..(5): Ava
LRMKXIYGYPKKGH

SEQ ID NO: 540 - protein, 28 aa, Artificial Sequence
  Description of Artificial Sequence: Synthetic hybrid peptide
  MOD_RES (5)..(5): Ava
LRMKXRNGYRALMDKSLHVGTQCALTRR

SEQ ID NO: 541 - protein, 14 aa, Artificial Sequence
  Description of Artificial Sequence: Synthetic hybrid peptide
  MOD_RES (5)..(5): Ava
LRMKXLTVILGVLL

SEQ ID NO: 542 - protein, 14 aa, Artificial Sequence
  Description of Artificial Sequence: Synthetic hybrid peptide
  MOD_RES (5)..(5): Ava
LRMKXVILGVLLLI

SEQ ID NO: 543 - protein, 14 aa, Artificial Sequence
  Description of Artificial Sequence: Synthetic hybrid peptide
  MOD_RES (5)..(5): Ava
LRMKXIGILTVILG

SEQ ID NO: 544 - protein, 19 aa, Artificial Sequence
  Description of Artificial Sequence: Synthetic hybrid peptide
  MOD_RES (5)..(5): Ava
LRMKXIGILTVILGVLLLI

SEQ ID NO: 545 - protein, 9 aa, Homo sapiens
LLLIGCWYC

SEQ ID NO: 546 - protein, 9 aa, Homo sapiens
ALMDKSLHV

SEQ ID NO: 547 - protein, 9 aa, Homo sapiens
EEAAGIGIL

SEQ ID NO: 548 - protein, 9 aa, Homo sapiens
AEQSPPPYS

SEQ ID NO: 549 - protein, 9 aa, Homo sapiens
AAGIGILTV

SEQ ID NO: 550 - protein, 9 aa, Homo sapiens
ILTVILGVL

SEQ ID NO: 551 - protein, 11 aa, Homo sapiens
AEEAAGIGILT

SEQ ID NO: 552 - protein, 37 aa, Artificial Sequence
  Description of Artificial Sequence: Synthetic hybrid peptide
  MOD_RES (5)..(5): Ava
LRMKXAAGIGILTVRNGYRALMDKSLHVGTQCALTRR

SEQ ID NO: 553 - protein, 1255 aa, Homo sapiens [sequence omitted]

SEQ ID NO: 554 - protein, 9 aa, Homo sapiens
FVVIQNEDL

SEQ ID NO: 555 - protein, 9 aa, Homo sapiens
LRIVRGTQL

SEQ ID NO: 556 - protein, 9 aa, Homo sapiens
MIMVKCWMI

SEQ ID NO: 557 - protein, 9 aa, Homo sapiens
LRRRFTHQS

SEQ ID NO: 558 - protein, 9 aa, Homo sapiens
YTMRRLLQE

SEQ ID NO: 559 - protein, 9 aa, Homo sapiens
VVLGVVFGI

SEQ ID NO: 560 - protein, 9 aa, Homo sapiens
MVHHRHRSS

SEQ ID NO: 561 - protein, 9 aa, Homo sapiens
LSVFQNLQV

SEQ ID NO: 562 - protein, 9 aa, Homo sapiens
LTLIDTNRS

SEQ ID NO: 563 - protein, 9 aa, Homo sapiens
FGILIKRRQ

SEQ ID NO: 564 - protein, 9 aa, Homo sapiens
LQVFETLEE

SEQ ID NO: 565 - protein, 9 aa, Homo sapiens
LTYLPTNAS

SEQ ID NO: 566 - protein, 9 aa, Homo sapiens
YMIMVKCWM

SEQ ID NO: 567 - protein, 9 aa, Homo sapiens
LRKVKVLGS

SEQ ID NO: 568 - protein, 9 aa, Homo sapiens
FQNLQVIRG

SEQ ID NO: 569 - protein, 15 aa, Homo sapiens
VPIKWMALESILRRR

SEQ ID NO: 570 - protein, 13 aa, Homo sapiens
GSPYVSRLLGICL

SEQ ID NO: 571 - protein, 11 aa, Homo sapiens
QLQVFETLEEI

SEQ ID NO: 572 - protein, 13 aa, Homo sapiens
LCFVHTVPWDQLF

SEQ ID NO: 573 - protein, 12 aa, Homo sapiens
GISWLGLRSLRE

SEQ ID NO: 574 - protein, 12 aa, Homo sapiens
EFSRMARDPQRF

SEQ ID NO: 575 - protein, 12 aa, Homo sapiens
FDGDLGMAAKGL

SEQ ID NO: 576 - protein, 15 aa, Homo sapiens
HLDMLRHLYQGCQVV

SEQ ID NO: 577 - protein, 16 aa, Homo sapiens
LRIVRGTQLFEDNYAL

SEQ ID NO: 578 - protein, 18 aa, Homo sapiens
TQRCEKCSKPCARVCYGL

SEQ ID NO: 579 - protein, 15 aa, Homo sapiens
LGSGAFGTVYKGIWI

SEQ ID NO: 580 - protein, 15 aa, Homo sapiens
PAREIPDLLEKGERL

SEQ ID NO: 581 - protein, 15 aa, Homo sapiens
TLERPKTLSPGKNGV

SEQ ID NO: 582 - protein, 17 aa, Homo sapiens
KKIFGSLAFLPESFDGD

SEQ ID NO: 583 - protein, 16 aa, Homo sapiens
RQQKIRKYTMRRLLQE

SEQ ID NO: 584 - protein, 14 aa, Homo sapiens
ELVSEFSRMARDPQ

SEQ ID NO: 585 - protein, 10 aa, Homo sapeins
LRIVRTGTQL

SEQ ID NO: 586 - protein, 9 aa, Homo sapeins
LVSEFSRMA

SEQ ID NO: 587 - protein, 18 aa, Artificial Sequence
  Description of Artificial Sequence: Synthetic hybrid peptide
  MOD_RES (5)..(5): Ava
LRMKXGSPYVSRLLGICL

SEQ ID NO: 588 - protein, 16 aa, Artificial Sequence
  Description of Artificial Sequence: Synthetic hybrid peptide
  MOD_RES (5)..(5): Ava
LRMKXQLQVFETLEEI

SEQ ID NO: 589 - protein, 14 aa, Artificial Sequence
  Description of Artificial Sequence: Synthetic hybrid peptide
  MOD_RES (5)..(5): Ava
LRMKXFVVIQNEDL

SEQ ID NO: 590 - protein, 14 aa, Artificial Sequence
  Description of Artificial Sequence: Synthetic hybrid peptide
  MOD_RES (5)..(5): Ava
LRMKXLRIVRGTQL

SEQ ID NO: 591 - protein, 14 aa, Artificial Sequence
  Description of Artificial Sequence: Synthetic hybrid peptide
  MOD_RES (5)..(5): Ava
LRMKXLRRRFTHQS

SEQ ID NO: 592 - protein, 14 aa, Artificial Sequence
  Description of Artificial Sequence: Synthetic hybrid peptide
  MOD_RES (5)..(5): Ava
LRMKXYTMRRLLQE

SEQ ID NO: 593 - protein, 14 aa, Artificial Sequence
  Description of Artificial Sequence: Synthetic hybrid peptide
  MOD_RES (5)..(5): Ava
LRMKXMVHHRHRSS

SEQ ID NO: 594 - protein, 14 aa, Artificial Sequence
  Description of Artificial Sequence: Synthetic hybrid peptide
  MOD_RES (5)..(5): Ava
LRMKXLVSEFSRMA

SEQ ID NO: 595 - protein, 25 aa, Artificial Sequence
  Description of Artificial Sequence: Synthetic hybrid peptide
  MOD_RES (5)..(5): Ava
LRMKXVPIKWMALESILRRRFTHQS

SEQ ID NO: 596 - protein, 20 aa, Artificial Sequence
  Description of Artificial Sequence: Synthetic hybrid peptide
  MOD_RES (5)..(5): Ava
LRMKXVVLGVVFGILIKRRQ

SEQ ID NO: 597 - protein, 15 aa, Artificial Sequence
  Description of Artificial Sequence: Synthetic hybrid peptide
  MOD_RES (5)..(5): Ava
LRMKXYMIMVKCWMI

SEQ ID NO: 598 - protein, 17 aa, Artificial Sequence
  Description of Artificial Sequence: Synthetic hybrid peptide
  MOD_RES (5)..(5): Ava
LRMKXLSVFQNLQVIRG

SEQ ID NO: 599 - protein, 9 aa, Homo sapiens
ILLVVVLGV

SEQ ID NO: 600 - protein, 9 aa, Homo sapiens
KIFGSLAFL

SEQ ID NO: 601 - protein, 9 aa, Homo sapiens
ILWKDIFHK

SEQ ID NO: 602 - protein, 9 aa, Homo sapiens
TYLPTNASL

SEQ ID NO: 603 - protein, 9 aa, Homo sapiens
QLFEDNYAL

SEQ ID NO: 604 - protein, 9 aa, Homo sapiens
EYVNARHCL

SEQ ID NO: 605 - protein, 9 aa, Homo sapiens
AYSLTLQGL

SEQ ID NO: 606 - protein, 9 aa, Homo sapiens
SYGVTVWEL

SEQ ID NO: 607 - protein, 9 aa, Homo sapiens
EYLVPQQGF

SEQ ID NO: 608 - protein, 9 aa, Homo sapiens
RLLQETELV

SEQ ID NO: 609 - protein, 9 aa, Homo sapiens
ILKETELRK

SEQ ID NO: 610 - protein, 9 aa, Homo sapiens
VLRENTSPK

SEQ ID NO: 611 - protein, 9 aa, Homo sapiens
ILIKRRQQK

SEQ ID NO: 612 - protein, 9 aa, Homo sapiens
QLFEDNYAL

SEQ ID NO: 613 - protein, 9 aa, Homo sapiens
KIFGSLAFL

SEQ ID NO: 614 - protein, 9 aa, Homo sapiens
RLLQETELV

SEQ ID NO: 615 - protein, 9 aa, Homo sapiens
ILHNGAYSL

SEQ ID NO: 616 - protein, 9 aa, Homo sapiens
VVLGVVFGI

SEQ ID NO: 617 - protein, 9 aa, Homo sapiens
YMIMVKCWM

SEQ ID NO: 618 - protein, 9 aa, Homo sapiens
IISAVVGIL

SEQ ID NO: 619 - protein, 10 aa, Homo sapiens
FLSAVVGILV

SEQ ID NO: 620 - protein, 10 aa, Homo sapiens
VMAGVGSPYV

SEQ ID NO: 621 - protein, 9 aa, Homo sapiens
VLRENTSPK

SEQ ID NO: 622 - protein, 23 aa, Artificial Sequence
  Description of Artificial Sequence: Synthetic hybrid peptide
  MOD_RES (5)..(5): Ava
LRMKXVMAGVGSPYVSRLLGICL

SEQ ID NO: 623 - protein, 25 aa, Artificial Sequence
  Description of Artificial Sequence: Synthetic hybrid peptide
  MOD_RES (5)..(5): Ava
LRMKXQLQVFETLEEIKIFGSLAFL

SEQ ID NO: 624 - protein, 16 aa, Artificial Sequence
  Description of Artificial Sequence: Synthetic hybrid peptide
  MOD_RES (5)..(5): Ava
LRMKXFGILIKRRQQK

SEQ ID NO: 625 - protein, 15 aa, Homo sapiens
TRTVCAGGCARCKGP

SEQ ID NO: 626 - protein, 15 aa, Homo sapiens
CAGGCARCKGPLPTD

SEQ ID NO: 627 - protein, 15 aa, Homo sapiens
QFLRQECVEECRVLQ

SEQ ID NO: 628 - protein, 15 aa, Homo sapiens
VLQGLPREYVNARHC

SEQ ID NO: 629 - protein, 15 aa, Homo sapiens
NGSVTCFGPEADQCV

SEQ ID NO: 630 - protein, 37 aa, Artificial Sequence
  Description of Artificial Sequence: Synthetic hybrid peptide
  MOD_RES (5)..(5): Ava
LRMKXGSPYVSRLLGICLTRTVCAGGCARCKGPLPTD

SEQ ID NO: 631 - protein, 31 aa, Artificial Sequence
  Description of Artificial Sequence: Synthetic hybrid peptide
  MOD_RES (5)..(5): Ava
LRMKXQLQVFETLEEINGSVTCFGPEADQCV

SEQ ID NO: 632 - protein, 22 aa, Artificial Sequence
  Description of Artificial Sequence: Synthetic hybrid peptide
  MOD_RES (5)..(5): Ava
LRMKXSQFLRGQECVEECRVLQ

SEQ ID NO: 633 - protein, 21 aa, Artificial Sequence
  Description of Artificial Sequence: Synthetic hybrid peptide
  MOD_RES (5)..(5): Ava
LRMKXRVLQGLPREYVNARHC

SEQ ID NO: 634 - protein, 14 aa, Artificial Sequence
  Description of Artificial Sequence: Synthetic peptide motif
HISLEALSDKKKIK

SEQ ID NO: 635 - protein, 15 aa, Artificial Sequence
  Description of Artificial Sequence: Synthetic peptide motif
EQEINLSLEELKDQR

SEQ ID NO: 636 - protein, 15 aa, Artificial Sequence
  Description of Artificial Sequence: Synthetic peptide motif
DDIIHSLSQEEKELL

SEQ ID NO: 637 - protein, 776 aa, Bacillus anthracis
AGGHGDVGMHVKEKEKNKDENKRKDEERNKTQEEHLKEIMKHIVKIEVKGEEAVKKEAAEKLLEKVPSDVLEMYKAIGGKIYIVDGDITKHISLEALSEDKKKIKDIYGKDALLHEHYVYAKEGYEPVLVIQSSEDYVENTEKALNVYYEIGKILSRDILSKINQPYQKFLDVLNTIKNASDSDGQDLLFTNQLKEHPTDFSVEFLEQNSNEVQEVFAKAFAYYIEPQHRDVLQLYAPEAFNYMDKFNEQEINLSLEELKDQRMLSRYEKWEKIKQHYQHWSDSLSEEGRGLLKKLQIPIEPKKDDIIHSLSQEEKELLKRIQIDSSDFLSTEEKEFLKKLQIDIRDSLSEEEKELLNRIQVDSSNPLSEKEKEFLKKLKLDIQPYDINQRLQDTGGLIDSPSINLDVRKQYKRDIQNIDALLHQSIGSTLYNKIYLYENMNINNLTATLGADLVDSTDNTKINRGIFNEFKKNFKYSISSNYMIVDINERPALDNERLKWRIQLSPDTRAGYLENGKLILQRNIGLEIKDVQIIKQSEKEYIRIDAKVVPKSKIDTKIQEAQLNINQEWNKALGLPKYTKLITFNVHNRYASNIVESAYLILNEWKNNIQSDLIKKVTNYLVDGNGRFVFTDITLPNIAEQYTHQDEIYEQVHSKGLYVPESRSILLHGPSKGVELRNDSEGFIHEFGHAVDDYAGYLLDKNQSDLVTNSKKFIDIFKEEGSNLTSYGRTNEAEFFAEAFRLMHSTDHAERLKVQKNAPKTFQFINDQIKFIINS

SEQ ID NO: 638 - protein, 9 aa, Bacillus anthracis
WRIQLSPDT

SEQ ID NO: 639 - protein, 9 aa, Bacillus anthracis
YIRIDAKVV

SEQ ID NO: 640 - protein, 9 aa, Bacillus anthracis
FRLMHSTDH

SEQ ID NO: 641 - protein, 9 aa, Bacillus anthracis
LQRNIGLEI

SEQ ID NO: 642 - protein, 9 aa, Bacillus anthracis
LQIDIRDSL

SEQ ID NO: 643 - protein, 9 aa, Bacillus anthracis
INLDVRKQY

SEQ ID NO: 644 - protein, 9 aa, Bacillus anthracis
LRNDSEGFI

SEQ ID NO: 645 - protein, 9 aa, Bacillus anthracis
LVIQSSEDY

SEQ ID NO: 646 - protein, 9 aa, Bacillus anthracis
YLLDKNQSD

SEQ ID NO: 647 - protein, 9 aa, Bacillus anthracis
YSISSNYMI

SEQ ID NO: 648 - protein, 9 aa, Bacillus anthracis
LIDSPSINL

SEQ ID NO: 649 - protein, 9 aa, Bacillus anthracis
IVESAYLIL

SEQ ID NO: 650 - protein, 9 aa, Bacillus anthracis
FKYSISSNY

SEQ ID NO: 651 - protein, 9 aa, Bacillus anthracis
FNYMDKFNE

SEQ ID NO: 652 - protein, 9 aa, Bacillus anthracis
FLKKLKLDI

SEQ ID NO: 653 - protein, 9 aa, Bacillus anthracis
VVPKSKIDT

SEQ ID NO: 654 - protein, 9 aa, Bacillus anthracis
YYEIGKILS

SEQ ID NO: 655 - protein, 9 aa, Bacillus anthracis
IQNIDALLH

SEQ ID NO: 656 - protein, 9 aa, Bacillus anthracis
LVTNSKKFI

SEQ ID NO: 657 - protein, 9 aa, Bacillus anthracis
LITFNVHNR

SEQ ID NO: 658 - protein, 9 aa, Bacillus anthracis
LEIKDVQII

SEQ ID NO: 659 - protein, 9 aa, Bacillus anthracis
IYLYENMNI

SEQ ID NO: 660 - protein, 9 aa, Bacillus anthracis
LEMYKAIGG

SEQ ID NO: 661 - protein, 9 aa, Bacillus anthracis
FIHEFGHAV

SEQ ID NO: 662 - protein, 9 aa, Bacillus anthracis
FINDQIKFI

SEQ ID NO: 663 - protein, 9 aa, Bacillus anthracis
VYYEIGKIL

SEQ ID NO: 664 - protein, 9 aa, Bacillus anthracis
HYQHWSDSL

SEQ ID NO: 665 - protein, 9 aa, Bacillus anthracis
LLHEHYVYA

SEQ ID NO: 666 - protein, 9 aa, Bacillus anthracis
STEEKEFLK

SEQ ID NO: 667 - protein, 9 aa, Bacillus anthracis
KLQIPIEPK

SEQ ID NO: 668 - protein, 9 aa, Bacillus anthracis
YVPESRSIL

SEQ ID NO: 669 - protein, 13 aa, Artificial Sequence
  Description of Artificial Sequence: Synthetic hybrid peptide
LRMKWRIQLSPDT

SEQ ID NO: 670 - protein, 13 aa, Artificial Sequence
  Description of Artificial Sequence: Synthetic hybrid peptide
LRMKYIRIDAKVV

SEQ ID NO: 671 - protein, 13 aa, Artificial Sequence
  Description of Artificial Sequence: Synthetic hybrid peptide
LRMKFRLMHSTDH

SEQ ID NO: 672 - protein, 14 aa, Artificial Sequence
  Description of Artificial Sequence: Synthetic hybrid peptide
LRMKLIQRNIGLEI

SEQ ID NO: 673 - protein, 13 aa, Artificial Sequence
  Description of Artificial Sequence: Synthetic hybrid peptide
LRMKLQIDIRDSL

SEQ ID NO: 674 - protein, 17 aa, Artificial Sequence
  Description of Artificial Sequence: Synthetic hybrid peptide
LRMKINLDVRKQYKRDI

SEQ ID NO: 675 - protein, 13 aa, Artificial Sequence
  Description of Artificial Sequence: Synthetic hybrid peptide
LRMKLRNDSEGFI

SEQ ID NO: 676 - protein, 14 aa, Artificial Sequence
  Description of Artificial Sequence: Synthetic hybrid peptide
LRMKYEPVQSSEDY

SEQ ID NO: 677 - protein, 23 aa, Artificial Sequence
  Description of Artificial Sequence: Synthetic hybrid peptide
LRMKPYQKFLDVLNTIKNASDSD

SEQ ID NO: 678 - protein, 28 aa, Artificial Sequence
  Description of Artificial Sequence: Synthetic hybrid peptide
LRMKTNQLKEHPTDFSVEFLEQNSNEVQ

SEQ ID NO: 679 - protein, 30 aa, Artificial Sequence
  Description of Artificial Sequence: Synthetic hybrid peptide
LRMKDFSVEFLEQNSNEVQEVFAKAFAYYI

SEQ ID NO: 680 - protein, 19 aa, Artificial Sequence
  Description of Artificial Sequence: Synthetic hybrid peptide
LRMKQHRDVLQLYAPEAFN

SEQ ID NO: 681 - protein, 764 aa, Bacillus anthracis
MKKRKVLIPLMALSTILVSSTGNLEVIQAEVKQENRLLNESESSSQGLLGYYFSDLNFQAPMVVTSSTTGDLSIPSSELENIPSENQYFQSAIWSGFIKVKKSDEYTFATSADNHVTMWVDDQEVINKASNSNKIRLEKGRLYQIKIQYQRENPTEKGLDFKLYWTDSQNKKEVISSDNLQLPELKQKSSNSRKKRSTSAGPTVPDRDNDGIPDSLEVEGYTVDVKNKRTFLSPWISNIHEKKGLTKYKSSPEKWSTASDPYSDFEKVTGRIDKNVSPEARHPLVAAYPIVHVDMENIILSKNEDQSTQNTDSQTRTISKNTSTSRTHTSEVHGNAEVHASFFDIGGSVSAGFSNSNSSTVAIDHSLSLAGERTWAETMGLNTADTARLNANIRYVNTGTAPIYNVLPTTSLVLGKNQTLATIKAKENQLSQILAPNNYYPSKNLAPIALNAQDDFSSTPITMNYNQFLELEKTKQLRLDTDQVYGNIATYNFENGRVRVDTGSNWSEVLPQIQETTARIIFNGKDLNLVERRIAAVNPSDPLETTKPDMTLKEALKIAFGFNEPNGNLQYQGKDITEFDFNFDQQTSQNIKNQLAELNVTNIYTVLDKIKLNAKMNILIRDKRFHYDRNNIAVGADESVVKEAHREVINSSTEGLLLNIDKDIRKILSGYIVEIEDTEGLKEVINDRYDMLNISSLRQDGKTFIDFKKYNDKLPLYISNPNYKVNVYAVTKENTIINPSENGDTSTNGIKKILIFSKKGYEIG

SEQ ID NO: 682 - protein, 9 aa, Bacillus anthracis
YNVLPTTSL

SEQ ID NO: 683 - protein, 9 aa, Bacillus anthracis
LIPLMALST

SEQ ID NO: 684 - protein, 9 aa, Bacillus anthracis
YVNTGTAPI

SEQ ID NO: 685 - protein, 9 aa, Bacillus anthracis
YISNPNYKV

SEQ ID NO: 686 - protein, 9 aa, Bacillus anthracis
LRQDGKTFI

SEQ ID NO: 687 - protein, 9 aa, Bacillus anthracis
LIRDKRFHY

SEQ ID NO: 688 - protein, 9 aa, Bacillus anthracis
IKLNAKMNI

SEQ ID NO: 689 - protein, 9 aa, Bacillus anthracis
FHYDRNNIA

SEQ ID NO: 690 - protein, 9 aa, Bacillus anthracis
IILSKNEDQ

SEQ ID NO: 691 - protein, 9 aa, Bacillus anthracis
VISSDNLQL

SEQ ID NO: 692 - protein, 9 aa, Bacillus anthracis
VINSSTEGL

SEQ ID NO: 693 - protein, 9 aa, Bacillus anthracis
FKLYWTDSQ

SEQ ID NO: 694 - protein, 9 aa, Bacillus anthracis
VKNKRTFLS

SEQ ID NO: 695 - protein, 9 aa, Bacillus anthracis
FIKVKKSDE

SEQ ID NO: 696 - protein, 9 aa, Bacillus anthracis
ILIFSKKGY

SEQ ID NO: 697 - protein, 9 aa, Bacillus anthracis
LLGYYFSDL

SEQ ID NO: 698 - protein, 9 aa, Bacillus anthracis
IRKILSGYI

SEQ ID NO: 699 - protein, 9 aa, Bacillus anthracis
VAIDHSLSL

SEQ ID NO: 700 - protein, 9 aa, Bacillus anthracis
ILSGYIVEI

SEQ ID NO: 701 - protein, 9 aa, Bacillus anthracis
AIWSGFIKV

SEQ ID NO: 702 - protein, 9 aa, Bacillus anthracis
FLSPWISNI

SEQ ID NO: 703 - protein, 9 aa, Bacillus anthracis
RLNANIRYV

SEQ ID NO: 704 - protein, 9 aa, Bacillus anthracis
NIKNQLAEL

SEQ ID NO: 705 - protein, 9 aa, Bacillus anthracis
SLEVEGYTV

SEQ ID NO: 706 - protein, 9 aa, Bacillus anthracis
KLNAKMNIL

SEQ ID NO: 707 - protein, 9 aa, Bacillus anthracis
YISNPNYKV

SEQ ID NO: 708 - protein, 9 aa, Bacillus anthracis
VAAYPIVHV

SEQ ID NO: 709 - protein, 9 aa, Bacillus anthracis
LVLGKNQTL

SEQ ID NO: 710 - protein, 12 aa, Artificial Sequence
  Description of Artificial Sequence: Synthetic hybrid peptide
LRMKNVLPTTSL

SEQ ID NO: 711 - protein, 13 aa, Artificial Sequence
  Description of Artificial Sequence: Synthetic hybrid peptide
LRMKLIPLMALST

SEQ ID NO: 712 - protein, 12 aa, Artificial Sequence
  Description of Artificial Sequence: Synthetic hybrid peptide
LRMKVNTGTAPI

SEQ ID NO: 713 - protein, 13 aa, Artificial Sequence
  Description of Artificial Sequence: Synthetic hybrid peptide
LRMKYISNPNYKV

SEQ ID NO: 714 - protein, 13 aa, Artificial Sequence
  Description of Artificial Sequence: Synthetic hybrid peptide
LRMKLRQDGKTFI

SEQ ID NO: 715 - protein, 13 aa, Artificial Sequence
  Description of Artificial Sequence: Synthetic hybrid peptide
LRMKLIRDKRFHY

SEQ ID NO: 716 - protein, 13 aa, Artificial Sequence
  Description of Artificial Sequence: Synthetic hybrid peptide
LRMKIKLNAKMNI

SEQ ID NO: 717 - protein, 13 aa, Artificial Sequence
  Description of Artificial Sequence: Synthetic hybrid peptide
LRMKFHYDRNNIA

SEQ ID NO: 718 - protein, 13 aa, Artificial Sequence
  Description of Artificial Sequence: Synthetic hybrid peptide
LRMKIILSKNEDQ

SEQ ID NO: 719 - protein, 13 aa, Artificial Sequence
  Description of Artificial Sequence: Synthetic hybrid peptide
LRMKVISSDNLQL

SEQ ID NO: 720 - protein, 33 aa, Artificial Sequence
  Description of Artificial Sequence: Synthetic hybrid peptide
  MOD_RES (5)..(5): Ava
LRMKXVISSDNLQLPELKQKSSNSRKKRSTSAG

SEQ ID NO: 721 - protein, 25 aa, Artificial Sequence
  Description of Artificial Sequence: Synthetic hybrid peptide
LRMKPDSLEVEGYTVDVKNKRTFLS

SEQ ID NO: 722 - protein, 34 aa, Artificial Sequence
  Description of Artificial Sequence: Synthetic hybrid peptide
LRMKVPDRDNDGIPDSLEVEGYTVDVKNKRTFLS

SEQ ID NO: 723 - protein, 26 aa, Artificial Sequence
  Description of Artificial Sequence: Synthetic hybrid peptide
  MOD_RES (5)..(5): Ava
LRMKXIRKILSGYIVEIEDTEGLKEV

SEQ ID NO: 724 - protein, 25 aa, Artificial Sequence
  Description of Artificial Sequence: Synthetic hybrid peptide
LRMKINDRYDMLNISSLRQDGKTFI

SEQ ID NO: 725 - protein, 13 aa, Artificial Sequence
  Description of Artificial Sequence: Synthetic hybrid peptide
LRMKYVNTGTAPI

SEQ ID NO: 726 - protein, 13 aa, Artificial Sequence
  Description of Artificial Sequence: Synthetic hybrid peptide
LRMKYVNTGTAPI

SEQ ID NO: 727 - protein, 14 aa, Artificial Sequence
  Description of Artificial Sequence: Synthetic hybrid peptide
  MOD_RES (5)..(5): Ava
LRMKXYVNTGTAPI

SEQ ID NO: 728 - protein, 14 aa, Artificial Sequence
  Description of Artificial Sequence: Synthetic hybrid peptide
  MOD_RES (5)..(5): Ava
LRMKXYVNTGTAPI

SEQ ID NO: 729 - protein, 14 aa, Artificial Sequence
  Description of Artificial Sequence: Synthetic hybrid peptide
  MOD_RES (5)..(5): Ava
LRMKXYVNTGTAPI

SEQ ID NO: 730 - protein, 14 aa, Artificial Sequence
  Description of Artificial Sequence: Synthetic hybrid peptide
  MOD_RES (5)..(5): Ava
LRMKXYVNTGTAPI

SEQ ID NO: 731 - protein, 13 aa, Artificial Sequence
  Description of Artificial Sequence: Synthetic hybrid peptide
LRMKYVNTGTAPI

SEQ ID NO: 732 - protein, 21 aa, Artificial Sequence
  Description of Artificial Sequence: Synthetic hybrid peptide
LRMKNGIKKILIFSKKGYEIG

SEQ ID NO: 733 - protein, 317 aa, Variola virus
MKTISVVTLLCVLPAVVYSTCTVPTMNNAKLTSTETSFNDKQKVTFTCDSGYYSLDPNAVCETDKWKYENPCKKMCTVSDYVSELYNKPLYEVNAIITLICKDETKYFRCEEKNGNTSWNDTVTCPNAECQSLQLDHGSCQPVKEKYSFGEHITINCDVGYEVIGASYITCTANSWNVIPSCQQKCDIPSLSNGLISGSTFSIGGVIHLSCKSGFILTGSPSSTCIDGKWNPVLPICIRSNEEFDPVEDGPDDETDLSKLSKDVVQYEQEIESLEATYHIIIVALTIMGVIFLISVIVLVCSCNKNNDQYKFHKLLL

SEQ ID NO: 734 - protein, 9 aa, Variola virus
VIFLISVIV

SEQ ID NO: 735 - protein, 9 aa, Variola virus
IFLISVIVL

SEQ ID NO: 736 - protein, 9 aa, Variola virus
FLISVIVLV

SEQ ID NO: 737 - protein, 9 aa, Variola virus
YYSLDPNAV

SEQ ID NO: 738 - protein, 9 aa, Variola virus
WNPVLPICI

SEQ ID NO: 739 - protein, 9 aa, Variola virus
IHLSCKSGF

SEQ ID NO: 740 - protein, 9 aa, Variola virus
IVALTIMGV

SEQ ID NO: 741 - protein, 9 aa, Variola virus
IIIVALTIM

SEQ ID NO: 742 - protein, 9 aa, Variola virus
FILTGSPSS

SEQ ID NO: 743 - protein, 9 aa, Variola virus
WNVIPSCQQ

SEQ ID NO: 744 - protein, 9 aa, Variola virus
YSLDPNAVC

SEQ ID NO: 745 - protein, 9 aa, Variola virus
YHIIIVALT

SEQ ID NO: 746 - protein, 9 aa, Variola virus
LTIMGVIFL

SEQ ID NO: 747 - protein, 9 aa, Variola virus
VTLLCVLPA

SEQ ID NO: 748 - protein, 9 aa, Variola virus
LYNKPLYEV

SEQ ID NO: 749 - protein, 9 aa, Variola virus
VIFLISVIV

SEQ ID NO: 750 - protein, 16 aa, Artificial Sequence
  Description of Artificial Sequence: Synthetic hybrid peptide
  MOD_RES (5)..(5): Ava
LRMKXVIFLISVIVLV

SEQ ID NO: 751 - protein, 14 aa, Artificial Sequence
  Description of Artificial Sequence: Synthetic hybrid peptide
  MOD_RES (5)..(5): Ava
LRMKXYYSLDPNAV

SEQ ID NO: 752 - protein, 14 aa, Artificial Sequence
  Description of Artificial Sequence: Synthetic hybrid peptide
  MOD_RES (5)..(5): Ava
LRMKXWNPVLPICI

SEQ ID NO: 753 - protein, 14 aa, Artificial Sequence
  Description of Artificial Sequence: Synthetic hybrid peptide
  MOD_RES (5)..(5): Ava
LRMKXIHLSCKSGF

SEQ ID NO: 754 - protein, 16 aa, Artificial Sequence
  Description of Artificial Sequence: Synthetic hybrid peptide
  MOD_RES (5)..(5): Ava
LRMKXIIIVALTIMGV

SEQ ID NO: 755 - protein, 14 aa, Artificial Sequence
  Description of Artificial Sequence: Synthetic hybrid peptide
  MOD_RES (5)..(5): Ava
LRMKXFILTGSPSS

SEQ ID NO: 756 - protein, 14 aa, Artificial Sequence
  Description of Artificial Sequence: Synthetic hybrid peptide
  MOD_RES (5)..(5): Ava
LRMKXWNVIPSCQQ

SEQ ID NO: 757 - protein, 14 aa, Artificial Sequence
  Description of Artificial Sequence: Synthetic hybrid peptide
  MOD_RES (5)..(5): Ava
LRMKXYHIIIVALT

SEQ ID NO: 758 - protein, 14 aa, Artificial Sequence
  Description of Artificial Sequence: Synthetic hybrid peptide
  MOD_RES (5)..(5): Ava
LRMKXYHIIIVALT

SEQ ID NO: 759 - protein, 14 aa, Artificial Sequence
  Description of Artificial Sequence: Synthetic hybrid peptide
  MOD_RES (5)..(5): Ava
LRMKXLTIMGVIFL

SEQ ID NO: 760 - protein, 14 aa, Artificial Sequence
  Description of Artificial Sequence: Synthetic hybrid peptide
  MOD_RES (5)..(5): Ava
LRMKXVTLLCVLPA

SEQ ID NO: 761 - protein, 14 aa, Artificial Sequence
  Description of Artificial Sequence: Synthetic hybrid peptide
  MOD_RES (5)..(5): Ava
LRMKXLYNKPLYEV

SEQ ID NO: 762 - protein, 14 aa, Artificial Sequence
  Description of Artificial Sequence: Synthetic hybrid peptide
  MOD_RES (5)..(5): Ava
LRMKXVIFLISVIV

SEQ ID NO: 763 - protein, 9 aa, Variola virus
FLISVIVLV

SEQ ID NO: 764 - protein, 9 aa, Variola virus
TLLCVLPAV

SEQ ID NO: 765 - protein, 9 aa, Variola virus
KMCTVSDYV

SEQ ID NO: 766 - protein, 9 aa, Variola virus
TIMGVIFLI

SEQ ID NO: 767 - protein, 9 aa, Variola virus
LLCVLPAVV

SEQ ID NO: 768 - protein, 9 aa, Variola virus
VLPAVVYST

SEQ ID NO: 769 - protein, 9 aa, Variola virus
VIFLISVIV

SEQ ID NO: 770 - protein, 9 aa, Variola virus
IVALTIMGV

SEQ ID NO: 771 - protein, 9 aa, Variola virus
TVSDYVSEL

SEQ ID NO: 772 - protein, 9 aa, Variola virus
LISGSTFSI

SEQ ID NO: 773 - protein, 16 aa, Artificial Sequence
  Description of Artificial Sequence: Synthetic hybrid peptide
  MOD_RES (5)..(5): Ava
LRMKXVIFLISVIVLV

SEQ ID NO: 774 - protein, 20 aa, Artificial Sequence
  Description of Artificial Sequence: Synthetic hybrid peptide
  MOD_RES (5)..(5): Ava
LRMKXTIMGVIFLISVIVLV

SEQ ID NO: 775 - protein, 22 aa, Artificial Sequence
  Description of Artificial Sequence: Synthetic hybrid peptide
  MOD_RES (5)..(5): Ava
LRMKXYHIIIVALTIMGVIFLI

SEQ ID NO: 776 - protein, 16 aa, Artificial Sequence
  Description of Artificial Sequence: Synthetic hybrid peptide
  MOD_RES (5)..(5): Ava
LRMKXVTLLCVLPAVV

SEQ ID NO: 777 - protein, 251 aa, Zaire ebolavirus
MAKATGRYNLISPKKDLEKGVVLSDLCNFLVSQTIQGWKVYWAGIEFDVTHKGMALLHRLKTNDFAPAWSMTRNLFPHLFQNPNSTIESPLWALRVILAAGIQDQLIDQSLIEPLAGALGLISDWLLTTNTNHFNMRTQRVKEQLSLKMLSLIRSNILKFINKLDALHVVNYNGLLSSIEIGTQNHTIIITRTNMGFLVELQEPDKSAMNRKKPGPAKFSLLHESTLKAFTQGSSTRMQSLILEFNSSLAI

SEQ ID NO: 778 - protein, 9 aa, Zaire ebolavirus
LRVILAAGI

SEQ ID NO: 779 - protein, 9 aa, Zaire ebolavirus
VVLSDLCNF

SEQ ID NO: 780 - protein, 9 aa, Zaire ebolavirus
LIRSNILKF

SEQ ID NO: 781 - protein, 9 aa, Zaire ebolavirus
LKMLSLIRS

SEQ ID NO: 782 - protein, 9 aa, Zaire ebolavirus
LKFINKLDA

SEQ ID NO: 783 - protein, 9 aa, Zaire ebolavirus
MTRQRVKEQ

SEQ ID NO: 784 - protein, 9 aa, Zaire ebolavirus
VNYNGLLSS

SEQ ID NO: 785 - protein, 9 aa, Zaire ebolavirus
LLHESTLKA

SEQ ID NO: 786 - protein, 9 aa, Zaire ebolavirus
WLLTTNTNH

SEQ ID NO: 787 - protein, 9 aa, Zaire ebolavirus
IIITRTNMG

SEQ ID NO: 788 - protein, 9 aa, Zaire ebolavirus
FLVSQTIQG

SEQ ID NO: 789 - protein, 9 aa, Zaire ebolavirus
IQGWKVYWA

SEQ ID NO: 790 - protein, 5 aa, Artificial Sequence
  Description of Artificial Sequence: Modified mammalian li-key peptide
LIVFM

SEQ ID NO: 791 - protein, 13 aa, Artificial Sequence
  Description of Artificial Sequence: Synthetic hybrid peptide
LRMKVVLSDLCNF

SEQ ID NO: 792 - protein, 13 aa, Artificial Sequence
  Description of Artificial Sequence: Synthetic hybrid peptide
LRMKFLVSQTIQG

SEQ ID NO: 793 - protein, 13 aa, Artificial Sequence
  Description of Artificial Sequence: Synthetic hybrid peptide
LRMKIQGWKVYWA

SEQ ID NO: 794 - protein, 19 aa, Artificial Sequence
  Description of Artificial Sequence: Synthetic hybrid peptide
LRMKFLVSQTIQGWKVYWA

SEQ ID NO: 795 - protein, 13 aa, Artificial Sequence
  Description of Artificial Sequence: Synthetic hybrid peptide
LRMKLKMLSLIRS

SEQ ID NO: 796 - protein, 13 aa, Artificial Sequence
  Description of Artificial Sequence: Synthetic hybrid peptide
LRMKLIRSNILKF

SEQ ID NO: 797 - protein, 13 aa, Artificial Sequence
  Description of Artificial Sequence: Synthetic hybrid peptide
LRMKLKFINKLDA

SEQ ID NO: 798 - protein, 18 aa, Artificial Sequence
  Description of Artificial Sequence: Synthetic hybrid peptide
LRMKLKMLSLIRSNILKF

SEQ ID NO: 799 - protein, 13 aa, Artificial Sequence
  Description of Artificial Sequence: Synthetic hybrid peptide
LRMKVNYNGLLSS

SEQ ID NO: 800 - protein, 13 aa, Artificial Sequence
  Description of Artificial Sequence: Synthetic hybrid peptide
LRMKLLHESTLKA

SEQ ID NO: 801 - protein, 4 aa, Artificial Sequence
  Description of Artificial Sequence: Synthetic hybrid peptide
LRMK

SEQ ID NO: 802 - protein, 9 aa, Zaire ebolavirus
VLSDLCNFL

SEQ ID NO: 803 - protein, 9 aa, Zaire ebolavirus
LILEFNSSL

SEQ ID NO: 804 - protein, 9 aa, Zaire ebolavirus
NILKFINKL

SEQ ID NO: 805 - protein, 9 aa, Zaire ebolavirus
ALGLISDWL

SEQ ID NO: 806 - protein, 9 aa, Zaire ebolavirus
SQTIQGWKV

SEQ ID NO: 807 - protein, 9 aa, Zaire ebolavirus
QLSLKMLSL

SEQ ID NO: 808 - protein, 9 aa, Zaire ebolavirus
SLIEPLAGA

SEQ ID NO: 809 - protein, 9 aa, Zaire ebolavirus
LLHESTLKA

SEQ ID NO: 810 - protein, 9 aa, Zaire ebolavirus
NLISPKKDL

SEQ ID NO: 811 - protein, 9 aa, Zaire ebolavirus
MLSLIRSNI

SEQ ID NO: 812 - protein, 9 aa, Zaire ebolavirus
LISDWLLTT

SEQ ID NO: 813 - protein, 9 aa, Zaire ebolavirus
GLISDWLLT

SEQ ID NO: 814 - protein, 14 aa, Artificial Sequence
  Description of Artificial Sequence: Synthetic hybrid peptide
LRMKVVLSDLCNFL

SEQ ID NO: 815 - protein, 20 aa, Artificial Sequence
  Description of Artificial Sequence: Synthetic hybrid peptide
LRMKVLSDLCNFLVSQTIQG

SEQ ID NO: 816 - protein, 18 aa, Artificial Sequence
  Description of Artificial Sequence: Synthetic hybrid peptide
LRMKGLISDWLLTTNTNH

SEQ ID NO: 817 - protein, 15 aa, Artificial Sequence
  Description of Artificial Sequence: Synthetic hybrid peptide
LRMKQLSLKMLSIRS

SEQ ID NO: 818 - protein, 18 aa, Artificial Sequence
  Description of Artificial Sequence: Synthetic hybrid peptide
LRMKQLSLKMLSLIRSNI

SEQ ID NO: 819 - protein, 15 aa, Artificial Sequence
  Description of Artificial Sequence: Synthetic hybrid peptide
LRMKNILKFINKLDA

SEQ ID NO: 820 - protein, 19 aa, Artificial Sequence
  Description of Artificial Sequence: Synthetic hybrid peptide
LRMKLIRSNILKFINKLDA

SEQ ID NO: 821 - protein, 13 aa, Artificial Sequence
  Description of Artificial Sequence: Synthetic hybrid peptide
LRMKLLHESTLKA

SEQ ID NO: 822 - protein, 12 aa, Homo sapiens
PVVHFFKNIVTP

SEQ ID NO: 823 - protein, 16 aa, Artificial Sequence
  Description of Artificial Sequence: Synthetic peptide
HCLGKWLGHPDKFVGI

SEQ ID NO: 824 - protein, 304 aa, Homo sapiens
MGNHAGKRELNAEKASTNSETNRGESEKKRNLGELSRTTSEDNEVFGEADANQNNGTSSQDTAVTDSKRTADPKNAWQDAHPADPGSRPHLIRLFSRDAPGREDNTFKDRPSESDELQTIQEDSAATSESLDVMASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKLGGRDSRSGSPMARR

SEQ ID NO: 825 - protein, 9 aa, Homo sapiens
LSKIFKLGG

SEQ ID NO: 826 - protein, 9 aa, Homo sapiens
RPHLIRLFS

SEQ ID NO: 827 - protein, 9 aa, Homo sapiens
HAGKRELNA

SEQ ID NO: 828 - protein, 9 aa, Homo sapiens
HKGFKGVDA

SEQ ID NO: 829 - protein, 9 aa, Homo sapiens
LQTIQEDSA

SEQ ID NO: 830 - protein, 9 aa, Homo sapiens
RDTGILDSI

SEQ ID NO: 831 - protein, 9 aa, Homo sapiens
DSKRTADPK

SEQ ID NO: 832 - protein, 9 aa, Homo sapiens
VHFFKNIVT

SEQ ID NO: 833 - protein, 9 aa, Homo sapiens
ASTMDHARH

SEQ ID NO: 834 - protein, 9 aa, Homo sapiens
KRNLGELSR

SEQ ID NO: 835 - protein, 9 aa, Homo sapiens
GRFFGGDRG

SEQ ID NO: 836 - protein, 44 aa, Homo sapiens
MGNHAGKRELNAEKASTNSETNRGESEKKRNLGELSRTTSEDNE

SEQ ID NO: 837 - protein, 36 aa, Homo sapiens
AWQDAHPADPGSRPHLIRLFSRDAPGREDNTFKDRP

SEQ ID NO: 838 - protein, 15 aa, Homo sapiens
LDVMASQKRPSQRHG

SEQ ID NO: 839 - protein, 16 aa, Homo sapiens
PSQRHGSKYLATASTM

SEQ ID NO: 840 - protein, 20 aa, Homo sapiens
AHPADPGSRPHLIRLFSRDA

SEQ ID NO: 841 - protein, 14 aa, Homo sapiens
LATASTMDHARHGF

SEQ ID NO: 842 - protein, 9 aa, Homo sapiens
FIRLFSRDA

SEQ ID NO: 843 - protein, 9 aa, Homo sapiens
IRLFSRDAP

SEQ ID NO: 844 - protein, 9 aa, Homo sapiens
IQWDSAATA

SEQ ID NO: 845 - protein, 9 aa, Homo sapiens
VMASQKRPS

SEQ ID NO: 846 - protein, 9 aa, Homo sapiens
LATASTMDH

SEQ ID NO: 847 - protein, 13 aa, Artificial Sequence
  Description of Artificial Sequence: Synthetic hybrid peptide
LRMKLSKIFKLGG

SEQ ID NO: 848 - protein, 13 aa, Artificial Sequence
  Description of Artificial Sequence: Synthetic hybrid peptide
LRMKRPHLIRLFS

SEQ ID NO: 849 - protein, 13 aa, Artificial Sequence
  Description of Artificial Sequence: Synthetic hybrid peptide
LRMKHAGKRELNA

SEQ ID NO: 850 - protein, 13 aa, Artificial Sequence
  Description of Artificial Sequence: Synthetic hybrid peptide
LRMKHKGFKGVDA

SEQ ID NO: 851 - protein, 13 aa, Artificial Sequence
  Description of Artificial Sequence: Synthetic hybrid peptide
LRMKHKGFKGVDA

SEQ ID NO: 852 - protein, 13 aa, Artificial Sequence
  Description of Artificial Sequence: Synthetic hybrid peptide
LRMKFIRLFSRDA

SEQ ID NO: 853 - protein, 13 aa, Artificial Sequence
  Description of Artificial Sequence: Synthetic hybrid peptide
LRMKIRLFSRDAP

SEQ ID NO: 854 - protein, 13 aa, Artificial Sequence
  Description of Artificial Sequence: Synthetic hybrid peptide
LRMKVMASQKRPS

SEQ ID NO: 855 - protein, 13 aa, Artificial Sequence
  Description of Artificial Sequence: Synthetic hybrid peptide
LRMKLATASTMDH

SEQ ID NO: 856 - protein, 16 aa, Homo sapiens
HCLGKWLGHPDKFVGI

SEQ ID NO: 857 - protein, 11 aa, Homo sapiens
WTTCDSIAFPS

SEQ ID NO: 858 - protein, 277 aa, Homo sapiens
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSRGQHQAHSLERVCHCLGKWLGHPDKFVGITYALTVVWLLVFACSAVPVYIYFNTWTTCDSIAFPSKTSASIGSLCADARMYGVLPWIAFPGKVCGSNLLSICKTAEFQMTFHLFIAAFVGAAATLVSLLTFMIAATYNFAVLKLMGRGTKF

SEQ ID NO: 859 - protein, 9 aa, Homo sapiens
FFFLYGALL

SEQ ID NO: 860 - protein, 9 aa, Homo sapiens
FVGAAATLV

SEQ ID NO: 861 - protein, 9 aa, Homo sapiens
FHLFIAAFV

SEQ ID NO: 862 - protein, 9 aa, Homo sapiens
LVSLLTFMI

SEQ ID NO: 863 - protein, 9 aa, Homo sapiens
WLLVFACSA

SEQ ID NO: 864 - protein, 9 aa, Homo sapiens
IFGDYKTTI

SEQ ID NO: 865 - protein, 9 aa, Homo sapiens
LCADARMYG

SEQ ID NO: 866 - protein, 9 aa, Homo sapiens
VIYGTASFF

SEQ ID NO: 867 - protein, 9 aa, Homo sapiens
YEYLINVIH

SEQ ID NO: 868 - protein, 9 aa, Homo sapiens
VGITYALTV

SEQ ID NO: 869 - protein, 16 aa, Homo sapiens
HCLGKWLGHPDKFVGI

SEQ ID NO: 870 - protein, 18 aa, Homo sapiens
FVGITYALTVVWLLVFAC

SEQ ID NO: 871 - protein, 5 aa, Artificial Sequence
  Description of Artificial Sequence: Synthetic peptide motif
LGKWL

SEQ ID NO: 872 - protein, 13 aa, Artificial Sequence
  Description of Artificial Sequence: Synthetic hybrid peptide
LRMKFFFLYGALL

SEQ ID NO: 873 - protein, 13 aa, Artificial Sequence
  Description of Artificial Sequence: Synthetic hybrid peptide
LRMKFVGAAATLV

SEQ ID NO: 874 - protein, 13 aa, Artificial Sequence
  Description of Artificial Sequence: Synthetic hybrid peptide
LRMKFHLFIAAFV

SEQ ID NO: 875 - protein, 13 aa, Artificial Sequence
  Description of Artificial Sequence: Synthetic hybrid peptide
LRMKLVSLLTFMI

SEQ ID NO: 876 - protein, 22 aa, Artificial Sequence
  Description of Artificial Sequence: Synthetic hybrid peptide
LRMKFVGITYALTVVWLLVFAC

SEQ ID NO: 877 - protein, 247 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFDPHFLRVPCWKITLFVIVPVLGPLVALIICYNWLHRRLAGQFLEELRNPF

SEQ ID NO: 878 - protein, 9 aa, Homo sapiens
LVLLAVLPV

SEQ ID NO: 879 - protein, 9 aa, Homo sapiens
FLRVPCWKI

SEQ ID NO: 880 - protein, 9 aa, Homo sapiens
FRVIGPRHP

SEQ ID NO: 881 - protein, 9 aa, Homo sapiens
LGPLVALII

SEQ ID NO: 882 - protein, 9 aa, Homo sapiens
FVIVPVLGP

SEQ ID NO: 883 - protein, 9 aa, Homo sapiens
FLLLLLLQV

SEQ ID NO: 884 - protein, 9 aa, Homo sapiens
LVGDEVELP

SEQ ID NO: 885 - protein, 9 aa, Homo sapiens
LLKDAIGEG

SEQ ID NO: 886 - protein, 9 aa, Homo sapiens
LRIRNVRFS

SEQ ID NO: 887 - protein, 9 aa, Homo sapiens
LLLQITVGL

SEQ ID NO: 888 - protein, 9 aa, Homo sapiens
WVSPGVLVL

SEQ ID NO: 889 - protein, 9 aa, Homo sapiens
YRLRGKLRA

SEQ ID NO: 890 - protein, 9 aa, Homo sapiens
WLHRRLAGQ

SEQ ID NO: 891 - protein, 19 aa, Homo sapiens
LLQVSSSYAGQFRVIGPRH

SEQ ID NO: 892 - protein, 13 aa, Artificial Sequence
  Description of Artificial Sequence: Synthetic hybrid peptide
LRMKLVLLAVLPV

SEQ ID NO: 893 - protein, 13 aa, Artificial Sequence
  Description of Artificial Sequence: Synthetic hybrid peptide
LRMKFLRVPCWKI

SEQ ID NO: 894 - protein, 13 aa, Artificial Sequence
  Description of Artificial Sequence: Synthetic hybrid peptide
LRMKFRVIGPRHP

SEQ ID NO: 895 - protein, 13 aa, Artificial Sequence
  Description of Artificial Sequence: Synthetic hybrid peptide
LRMKFVIVPVLGP

SEQ ID NO: 896 - protein, 17 aa, Artificial Sequence
  Description of Artificial Sequence: Synthetic hybrid peptide
LRMKFLLLLLLQVSSSY

SEQ ID NO: 897 - protein, 16 aa, Artificial Sequence
  Description of Artificial Sequence: Synthetic hybrid peptide
LRMKFRVIGPRHPIRA

SEQ ID NO: 898 - protein, 36 aa, Human immunodeficiency virus type 1
NDIQKLVGKLNWASQIYPGIKVRQLCKLLRGTKALT

SEQ ID NO: 899 - protein, 15 aa, Artificial Sequence
  Description of Artificial Sequence: Synthetic hybrid peptide
  MOD_RES (5)..(5): Ava
LRMKXIAYLKQATAK

SEQ ID NO: 900 - protein, 10 aa, Artificial Sequence
  Description of Artificial Sequence: Synthetic peptide
IAYLKQATAK

SEQ ID NO: 901 - protein, 16 aa, Artificial Sequence
  Description of Artificial Sequence: Synthetic hybrid peptide
  MOD_RES (5)..(6): Ava
LRMKXXAYRAIRHIPR

SEQ ID NO: 902 - protein, 15 aa, Artificial Sequence
  Description of Artificial Sequence: Synthetic hybrid peptide
  MOD_RES (5)..(5): Ava
LRMKXAYRAIRHIPR

SEQ ID NO: 903 - protein, 14 aa, Artificial Sequence
  Description of Artificial Sequence: Synthetic hybrid peptide
  MOD_RES (5)..(5): Ava
LRMKXYRAIRHIPR

SEQ ID NO: 904 - protein, 14 aa, Artificial Sequence
  Description of Artificial Sequence: Synthetic hybrid peptide
LRMKAYRAIRHIPR

SEQ ID NO: 905 - protein, 16 aa, Unknown
  Description of Unknown Organism: Mammalian li-key peptide
LRMKLPKPPKPVSQMR

SEQ ID NO: 906 - DNA, 20 bp, Artificial Sequence
  Description of Artificial Sequence: Synthetic nucleotide sequence
tccatgacgttcctgacgtt

SEQ ID NO: 907 - protein, 13 aa, Homo sapiens
RQLYPEWTEAQRL

SEQ ID NO: 908 - protein, 15 aa, Homo sapiens
GVGSPYVSRLLGICL

SEQ ID NO: 909 - protein, 13 aa, Artificial Sequence
  Description of Artificial Sequence: Synthetic hybrid peptide
RQLYPEWTEAQRL

SEQ ID NO: 910 - protein, 19 aa, Artificial Sequence
  Description of Artificial Sequence: Synthetic hybrid peptide
  MOD_RES (5)..(5): Ava
LRMKXNRQLYPEWTEAQRL

SEQ ID NO: 911 - protein, 18 aa, Artificial Sequence
  Description of Artificial Sequence: Synthetic hybrid peptide
  MOD_RES (5)..(5): Ava
LRMKXRQLYPEWTEAQRL

SEQ ID NO: 912 - protein, 17 aa, Artificial Sequence
  Description of Artificial Sequence: Synthetic hybrid peptide
  MOD_RES (5)..(5): Ava
LRMKXQLYPEWTEAQRL

SEQ ID NO: 913 - protein, 16 aa, Artificial Sequence
  Description of Artificial Sequence: Synthetic hybrid peptide
  MOD_RES (5)..(5): Ava
LRMKXLYPEWTEAQRL

SEQ ID NO: 914 - protein, 19 aa, Artificial Sequence
  Description of Artificial Sequence: Synthetic hybrid peptide
  MOD_RES (5)..(5): Ava
LRMKXATALYWTEAQRLRL

SEQ ID NO: 915 - protein, 18 aa, Artificial Sequence
  Description of Artificial Sequence: Synthetic hybrid peptide
  MOD_RES (5)..(5): Ava
LRMKXTALYPEWTEAQRL

SEQ ID NO: 916 - protein, 17 aa, Artificial Sequence
  Description of Artificial Sequence: Synthetic hybrid peptide
  MOD_RES (5)..(5): Ava
LRMKXALYPEWTEAQRL

SEQ ID NO: 917 - protein, 17 aa, Artificial Sequence
  Description of Artificial Sequence: Synthetic hybrid peptide
  MOD_RES (5)..(6): Ava
LRMKXXLYPEWTEAQRL

SEQ ID NO: 918 - protein, 18 aa, Artificial Sequence
  Description of Artificial Sequence: Synthetic hybrid peptide
  MOD_RES (5)..(5): Ava
LRMKXNRQLYPEWTEAQR

SEQ ID NO: 919 - protein, 17 aa, Artificial Sequence
  Description of Artificial Sequence: Synthetic hybrid peptide
  MOD_RES (5)..(5): Ava
LRMKXNRQLYPEWTEAQ

SEQ ID NO: 920 - protein, 11 aa, Artificial Sequence
  Description of Artificial Sequence: Synthetic hybrid peptide
LYPEWTEAQRL

SEQ ID NO: 921 - protein, 17 aa, Artificial Sequence
  Description of Artificial Sequence: Synthetic hybrid peptide
ALHIYMDGTMSQVQGSA

SEQ ID NO: 922 - protein, 19 aa, Artificial Sequence
  Description of Artificial Sequence: Synthetic hybrid peptide
HNALHIYMDGTMSQVQGSA

SEQ ID NO: 923 - protein, 23 aa, Artificial Sequence
  Description of Artificial Sequence: Synthetic hybrid peptide
  MOD_RES (5)..(5): Ava
LRMKXNALHIYMDGTMSQVQGSA

SEQ ID NO: 924 - protein, 22 aa, Artificial Sequence
  Description of Artificial Sequence: Synthetic hybrid peptide
  MOD_RES (5)..(5): Ava
LRMKXALHIYMDGTMSQVQGSA

SEQ ID NO: 925 - protein, 21 aa, Artificial Sequence
  Description of Artificial Sequence: Synthetic hybrid peptide
  MOD_RES (5)..(5): Ava
LRMKXLHIYMDGTMSQVQGSA

SEQ ID NO: 926 - protein, 20 aa, Artificial Sequence
  Description of Artificial Sequence: Synthetic hybrid peptide
  MOD_RES (5)..(5): Ava
LRMKXHIYMDGTMSQVQGSA

SEQ ID NO: 927 - protein, 19 aa, Artificial Sequence
  Description of Artificial Sequence: Synthetic hybrid peptide
  MOD_RES (5)..(5): Ava
LRMKXIYMDGTMSQVQGSA

SEQ ID NO: 928 - protein, 18 aa, Artificial Sequence
  Description of Artificial Sequence: Synthetic hybrid peptide
  MOD_RES (5)..(5): Ava
LRMKXYMDGTMSQVQGSA

SEQ ID NO: 929 - protein, 17 aa, Artificial Sequence
  Description of Artificial Sequence: Synthetic hybrid peptide
  MOD_RES (5)..(5): Ava
LRMKXMDGTMSQVQGSA

SEQ ID NO: 930 - protein, 1258 aa, Homo sapiens
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPVCID

SEQ ID NO: 931 - protein, 19 aa, Artificial Sequence
  Description of Artificial Sequence: Synthetic hybrid peptide
LRMKGVGSPYVSRLLGICL

SEQ ID NO: 932 - protein, 20 aa, Artificial Sequence
  Description of Artificial Sequence: Synthetic hybrid peptide
  MOD_RES (5)..(5): Ava
LRMKXGVGSPYVSRLLGICL

SEQ ID NO: 933 - protein, 19 aa, Artificial Sequence
  Description of Artificial Sequence: Synthetic hybrid peptide
  MOD_RES (5)..(5): Ava
LRMKXVGSPYVSRLLGICL

SEQ ID NO: 934 - protein, 18 aa, Artificial Sequence
  Description of Artificial Sequence: Synthetic hybrid peptide
  MOD_RES (5)..(5): Ava
LRMKXGSPYVSRLLGICL

SEQ ID NO: 935 - protein, 17 aa, Artificial Sequence
  Description of Artificial Sequence: Synthetic hybrid peptide
  MOD_RES (5)..(5): Ava
LRMKXSPYVSRLLGICL

SEQ ID NO: 936 - protein, 12 aa, Human immunodeficiency virus type 1
NKIVRMYSPTSI

SEQ ID NO: 937 - protein, 13 aa, Human immunodeficiency virus type 1
RFYKTLRAEQASQ

SEQ ID NO: 938 - protein, 18 aa, Artificial Sequence
  Description of Artificial Sequence: Synthetic hybrid peptide
WIILGLNKIVRMYSPTSI

SEQ ID NO: 939 - protein, 12 aa, Artificial Sequence
  Description of Artificial Sequence: Synthetic hybrid peptide
WIILGLNKIVRM

SEQ ID NO: 940 - protein, 11 aa, Artificial Sequence
  Description of Artificial Sequence: Synthetic hybrid peptide
ILGLNKIVRMY

SEQ ID NO: 941 - protein, 23 aa, Artificial Sequence
  Description of Artificial Sequence: Synthetic hybrid peptide
  MOD_RES (5)..(5): Ava
LRLKXWIILGLNKIVRMYSPTSI

SEQ ID NO: 942 - protein, 22 aa, Artificial Sequence
  Description of Artificial Sequence: Synthetic hybrid peptide
  MOD_RES (5)..(5): Ava
LRLKXIILGLNKIVRMYSPTSI

SEQ ID NO: 943 - protein, 21 aa, Artificial Sequence
  Description of Artificial Sequence: Synthetic hybrid peptide
  MOD_RES (5)..(5): Ava
LRLKXILGLNKIVRMYSPTSI

SEQ ID NO: 944 - protein, 20 aa, Artificial Sequence
  Description of Artificial Sequence: Synthetic hybrid peptide
  MOD_RES (5)..(5): Ava
LRLKXLGLNKIVRMYSPTSI

SEQ ID NO: 945 - protein, 19 aa, Artificial Sequence
  Description of Artificial Sequence: Synthetic hybrid peptide
  MOD_RES (5)..(5): Ava
LRLKXGLNKIVRMYSPTSI

SEQ ID NO: 946 - protein, 18 aa, Artificial Sequence
  Description of Artificial Sequence: Synthetic hybrid peptide
  MOD_RES (5)..(5): Ava
LRLKXLNKIVRMYSPTSI

SEQ ID NO: 947 - protein, 17 aa, Artificial Sequence
  Description of Artificial Sequence: Synthetic hybrid peptide
  MOD_RES (5)..(5): Ava
LRLKXNKIVRMYSPTSI

SEQ ID NO: 948 - protein, 16 aa, Artificial Sequence
  Description of Artificial Sequence: Synthetic hybrid peptide
  MOD_RES (5)..(5): Ava
LRLKXKIVRMYSPTSI

SEQ ID NO: 949 - protein, 22 aa, Artificial Sequence
  Description of Artificial Sequence: Synthetic hybrid peptide
  MOD_RES (5)..(5): Ava
LRLKXIILGLDKIVRMYSPTSI

SEQ ID NO: 950 - protein, 18 aa, Artificial Sequence
  Description of Artificial Sequence: Synthetic hybrid peptide
YVDRFYKTLRAEQASQEV

SEQ ID NO: 951 - protein, 23 aa, Artificial Sequence
  Description of Artificial Sequence: Synthetic hybrid peptide
  MOD_RES (5)..(5): Ava
LRLKXYVDRFYKTLRAEQASQEV

SEQ ID NO: 952 - protein, 22 aa, Artificial Sequence
  Description of Artificial Sequence: Synthetic hybrid peptide
  MOD_RES (5)..(5): Ava
LRLKXVDRFYKTLRAEQASQEV

SEQ ID NO: 953 - protein, 21 aa, Artificial Sequence
  Description of Artificial Sequence: Synthetic hybrid peptide
  MOD_RES (5)..(5): Ava
LRLKXDRFYKTLRAEQASQEV

SEQ ID NO: 954 - protein, 20 aa, Artificial Sequence
  Description of Artificial Sequence: Synthetic hybrid peptide
  MOD_RES (5)..(5): Ava
LRLKXRFYKTLRAEQASQEV

SEQ ID NO: 955 - protein, 19 aa, Artificial Sequence
  Description of Artificial Sequence: Synthetic hybrid peptide
  MOD_RES (5)..(5): Ava
LRLKXFYKTLRAEQASQEV

SEQ ID NO: 956 - protein, 18 aa, Artificial Sequence
  Description of Artificial Sequence: Synthetic hybrid peptide
  MOD_RES (5)..(5): Ava
LRLKXYKTLRAEQASQEV

SEQ ID NO: 957 - protein, 22 aa, Artificial Sequence
  Description of Artificial Sequence: Synthetic hybrid peptide
  MOD_RES (5)..(5): Ava
LRLKXVDRFYKTLRAEEASQEV

SEQ ID NO: 958 - protein, 22 aa, Artificial Sequence
  Description of Artificial Sequence: Synthetic hybrid peptide
  MOD_RES (5)..(5): Ava
LRLKXVDRFYKTLRAEQASEEV

SEQ ID NO: 959 - protein, 22 aa, Artificial Sequence
  Description of Artificial Sequence: Synthetic hybrid peptide
  MOD_RES (5)..(5): Ava
LRLKXVDRFYKTLRAEEASEEV

SEQ ID NO: 960 - protein, 17 aa, Artificial Sequence
  Description of Artificial Sequence: Synthetic hybrid peptide
VDRFYKTLRAEQASQEV

SEQ ID NO: 961 - protein, 15 aa, Artificial Sequence
  Description of Artificial Sequence: Synthetic hybrid peptide
RFYKTLRAEQASQEV

SEQ ID NO: 962 - protein, 19 aa, Artificial Sequence
  Description of Artificial Sequence: Synthetic hybrid peptide
  MOD_RES (5)..(5): Ava
LRLKXFYKTLRAEQASQEV

SEQ ID NO: 963 - protein, 24 aa, Artificial Sequence
  Description of Artificial Sequence: Synthetic hybrid peptide
  MOD_RES (5)..(5): Ava
LMRKXNNPPIPVGEIYKRWIILGL

SEQ ID NO: 964 - protein, 23 aa, Artificial Sequence
  Description of Artificial Sequence: Synthetic hybrid peptide
  MOD_RES (5)..(5): Ava
LMRKXNPPIPVGEIYKRWIILGL

SEQ ID NO: 965 - protein, 22 aa, Artificial Sequence
  Description of Artificial Sequence: Synthetic hybrid peptide
  MOD_RES (5)..(5): Ava
LMRKXPPIPVGEIYKRWIILGL

SEQ ID NO: 966 - protein, 21 aa, Artificial Sequence
  Description of Artificial Sequence: Synthetic hybrid peptide
  MOD_RES (5)..(5): Ava
LMRKXPIPVGEIYKRWIILGL

SEQ ID NO: 967 - protein, 20 aa, Artificial Sequence
  Description of Artificial Sequence: Synthetic hybrid peptide
  MOD_RES (5)..(5): Ava
LMRKXIPVGEIYKRWIILGL

SEQ ID NO: 968 - protein, 19 aa, Artificial Sequence
  Description of Artificial Sequence: Synthetic hybrid peptide
  MOD_RES (5)..(5): Ava
LMRKXPVGEIYKRWIILGL

SEQ ID NO: 969 - protein, 18 aa, Artificial Sequence
  Description of Artificial Sequence: Synthetic hybrid peptide
  MOD_RES (5)..(5): Ava
LMRKXVGEIYKRWIILGL

SEQ ID NO: 970 - protein, 17 aa, Artificial Sequence
  Description of Artificial Sequence: Synthetic hybrid peptide
  MOD_RES (5)..(5): Ava
LMRKXGEIYKRWIILGL

SEQ ID NO: 971 - protein, 16 aa, Artificial Sequence
  Description of Artificial Sequence: Synthetic hybrid peptide
  MOD_RES (5)..(5): Ava
LMRKXEIYKRWIILGL

SEQ ID NO: 972 - protein, 15 aa, Artificial Sequence
  Description of Artificial Sequence: Synthetic hybrid peptide
  MOD_RES (5)..(5): Ava
LMRKXIYKRWIILGL

SEQ ID NO: 973 - protein, 14 aa, Artificial Sequence
  Description of Artificial Sequence: Synthetic hybrid peptide
  MOD_RES (5)..(5): Ava
LMRKXYKRWIILGL

SEQ ID NO: 974 - protein, 12 aa, Artificial Sequence
  Description of Artificial Sequence: Synthetic hybrid peptide
GEIYKRWIILGL

SEQ ID NO: 975 - protein, 18 aa, Artificial Sequence
  Description of Artificial Sequence: Synthetic hybrid peptide
  MOD_RES (5)..(6): Ava
LMRKXXGEIYKRWIILGL

SEQ ID NO: 976 - protein, 16 aa, Artificial Sequence
  Description of Artificial Sequence: Synthetic hybrid peptide
  MOD_RES (5)..(6): Ava
LMRKXXIYKRWIILGL

SEQ ID NO: 977 - protein, 12 aa, Artificial Sequence
  Description of Artificial Sequence: Synthetic hybrid peptide
GEIYKRWIILGL

SEQ ID NO: 978 - protein, 500 aa, Human immunodeficiency virus type 1
MGARASVLSGGELDRWEKIRLRPGGKKKYKLKHIVWASRELERFAVNPGLLETSEGCRQILGQLQPSLQTGSEELRSLYNTVATLYCVHQRIEIKDTKEALDKIEEEQNKSKKKAQQAAADTGHSNQVSQNYPIVQNIQGQMVHQAISPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRKIVKCFNCGKEGHTARNCRAPRKKGCWKCGKEGHQMKDCTERQANFLGKIWPSYKGRPGNFLQSRPEPTAPPEESFRSGVETTTPPQKQEPIDKELYPLTSLRSLFGNDPSSQ

SEQ ID NO: 979 - protein, 18 aa, Artificial Sequence
  Description of Artificial Sequence: Synthetic hybrid peptide
  MOD_RES (5)..(5): Ava
LRMKXYVDRFYKTLRAEQ

SEQ ID NO: 980 - protein, 18 aa, Artificial Sequence
  Description of Artificial Sequence: Synthetic hybrid peptide
  MOD_RES (5)..(5): Ava
LRMKXWEKIRLRPGGKKK

SEQ ID NO: 981 - protein, 18 aa, Artificial Sequence
  Description of Artificial Sequence: Synthetic hybrid peptide
  MOD_RES (5)..(5): Ava
LRMKXTGSEELRSLYNTV

SEQ ID NO: 982 - protein, 18 aa, Artificial Sequence
  Description of Artificial Sequence: Synthetic hybrid peptide
  MOD_RES (5)..(5): Ava
LRMKXEAMSQVTNSATIM

SEQ ID NO: 983 - protein, 18 aa, Artificial Sequence
  Description of Artificial Sequence: Synthetic hybrid peptide
  MOD_RES (5)..(5): Ava
LRMKXWIILGLNKIVRMY

SEQ ID NO: 984 - protein, 18 aa, Artificial Sequence
  Description of Artificial Sequence: Synthetic hybrid peptide
  MOD_RES (5)..(5): Ava
LRMKXLSGGELDRWEKIR

SEQ ID NO: 985 - protein, 18 aa, Artificial Sequence
  Description of Artificial Sequence: Synthetic hybrid peptide
  MOD_RES (5)..(5): Ava
LRMKXYPLTSLRSLFGND

SEQ ID NO: 986 - protein, 18 aa, Artificial Sequence
  Description of Artificial Sequence: Synthetic hybrid peptide
  MOD_RES (5)..(5): Ava
LRMKXEGCRQILGQLQPS

SEQ ID NO: 987 - protein, 18 aa, Artificial Sequence
  Description of Artificial Sequence: Synthetic hybrid peptide
  MOD_RES (5)..(5): Ava
LRMKXEALDKIEEEQNKS

SEQ ID NO: 988 - protein, 18 aa, Artificial Sequence
  Description of Artificial Sequence: Synthetic hybrid peptide
  MOD_RES (5)..(5): Ava
LRMKXPEVIPMFSALSEG

SEQ ID NO: 989 - protein, 18 aa, Artificial Sequence
  Description of Artificial Sequence: Synthetic hybrid peptide
  MOD_RES (5)..(5): Ava
LRMKXRTLNAWVKVVEEK

SEQ ID NO: 990 - protein, 18 aa, Artificial Sequence
  Description of Artificial Sequence: Synthetic hybrid peptide
  MOD_RES (5)..(5): Ava
LRMKXFSPEVIPMFSALS

SEQ ID NO: 991 - protein, 18 aa, Artificial Sequence
  Description of Artificial Sequence: Synthetic hybrid peptide
  MOD_RES (5)..(5): Ava
LRMKXDLNTMLNTVGGHQ

SEQ ID NO: 992 - protein, 18 aa, Artificial Sequence
  Description of Artificial Sequence: Synthetic hybrid peptide
  MOD_RES (5)..(5): Ava
LRMKXTLNAWVKVVEEKA

SEQ ID NO: 993 - protein, 18 aa, Artificial Sequence
  Description of Artificial Sequence: Synthetic hybrid peptide
  MOD_RES (5)..(5): Ava
LRMKXIQGQMVHQAISPR

SEQ ID NO: 994 - protein, 18 aa, Artificial Sequence
  Description of Artificial Sequence: Synthetic hybrid peptide
  MOD_RES (5)..(5): Ava
LRMKXAAMQMLKETINEE

SEQ ID NO: 995 - protein, 18 aa, Artificial Sequence
  Description of Artificial Sequence: Synthetic hybrid peptide
  MOD_RES (5)..(5): Ava
LRMKXGELDRWEKIRLRP

SEQ ID NO: 996 - protein, 18 aa, Artificial Sequence
  Description of Artificial Sequence: Synthetic hybrid peptide
  MOD_RES (5)..(5): Ava
LRMKXGLNKIVRMYSPTS

SEQ ID NO: 997 - protein, 18 aa, Artificial Sequence
  Description of Artificial Sequence: Synthetic hybrid peptide
  MOD_RES (5)..(5): Ava
LRMKXEIYKRWIILGLNK

SEQ ID NO: 998 - protein, 18 aa, Artificial Sequence
  Description of Artificial Sequence: Synthetic hybrid peptide
  MOD_RES (5)..(5): Ava
LRMKXVHQRIEIKDTKEA

SEQ ID NO: 999 - protein, 18 aa, Artificial Sequence
  Description of Artificial Sequence: Synthetic hybrid peptide
  MOD_RES (5)..(5): Ava
LRMKXPEVIPMFSALSEG

SEQ ID NO: 1000 - protein, 18 aa, Artificial Sequence
  Description of Artificial Sequence: Synthetic hybrid peptide
  MOD_RES (5)..(5): Ava
LRMKXKIVRMYSPTSILD

SEQ ID NO: 1001 - protein, 18 aa, Artificial Sequence
  Description of Artificial Sequence: Synthetic hybrid peptide
  MOD_RES (5)..(5): Ava
LRMKXQVSQNYPIVQNIQ

SEQ ID NO: 1002 - protein, 18 aa, Artificial Sequence
  Description of Artificial Sequence: Synthetic hybrid peptide
  MOD_RES (5)..(5): Ava
LRMKXQASQEVKNWMTET

SEQ ID NO: 1003 - protein, 18 aa, Artificial Sequence
  Description of Artificial Sequence: Synthetic hybrid peptide
  MOD_RES (5)..(5): Ava
LRMKXQNYPIVQNIQGQM

SEQ ID NO: 1004 - protein, 18 aa, Artificial Sequence
  Description of Artificial Sequence: Synthetic hybrid peptide
  MOD_RES (5)..(5): Ava
LRMKXTSILDIRQGPKEP

SEQ ID NO: 1005 - protein, 18 aa, Artificial Sequence
  Description of Artificial Sequence: Synthetic hybrid peptide
  MOD_RES (5)..(5): Ava
LRMKXWIILGLNKIVRMY

SEQ ID NO: 1006 - protein, 18 aa, Artificial Sequence
  Description of Artificial Sequence: Synthetic hybrid peptide
  MOD_RES (5)..(5): Ava
LRMKXIDKELYPLTSLRS

SEQ ID NO: 1007 - protein, 18 aa, Artificial Sequence
  Description of Artificial Sequence: Synthetic hybrid peptide
  MOD_RES (5)..(5): Ava
LRMKXEEAAEWDRVHPVH

SEQ ID NO: 1008 - protein, 18 aa, Artificial Sequence
  Description of Artificial Sequence: Synthetic hybrid peptide
  MOD_RES (5)..(5): Ava
LRMKXSPPRTLNAWVKVV

SEQ ID NO: 1009 - protein, 19 aa, Artificial Sequence
  Description of Artificial Sequence: Synthetic hybrid peptide
  MOD_RES (5)..(5): Ava
LRMKXGYKVLVLNPSVAAT

SEQ ID NO: 1010 - protein, 18 aa, Artificial Sequence
  Description of Artificial Sequence: Synthetic hybrid peptide
  MOD_RES (5)..(5): Ava
LRMKXYKVLVLNPSVAAT

SEQ ID NO: 1011 - protein, 17 aa, Artificial Sequence
  Description of Artificial Sequence: Synthetic hybrid peptide
  MOD_RES (5)..(5): Ava
LRMKXKVLVLNPSVAAT

SEQ ID NO: 1012 - protein, 16 aa, Artificial Sequence
  Description of Artificial Sequence: Synthetic hybrid peptide
  MOD_RES (5)..(5): Ava
LRMKXVLVLNPSVAAT

SEQ ID NO: 1013 - protein, 15 aa, Artificial Sequence
  Description of Artificial Sequence: Synthetic hybrid peptide
  MOD_RES (5)..(5): Ava
LRMKXLVLNPSVAAT

SEQ ID NO: 1014 - protein, 16 aa, Artificial Sequence
  Description of Artificial Sequence: Synthetic hybrid peptide
  MOD_RES (5)..(5): Ava
LRMKXVLVLDPSVAAT

SEQ ID NO: 1015 - protein, 14 aa, Artificial Sequence
  Description of Artificial Sequence: Synthetic hybrid peptide
GYKVLVLNPSVAAT

SEQ ID NO: 1016 - protein, 11 aa, Artificial Sequence
  Description of Artificial Sequence: Synthetic hybrid peptide
VLVLNPSVAAT

SEQ ID NO: 1017 - protein, 11 aa, Artificial Sequence
  Description of Artificial Sequence: Synthetic hybrid peptide
VLVLDPSVAAT

SEQ ID NO: 1018 - protein, 20 aa, Artificial Sequence
  Description of Artificial Sequence: Synthetic hybrid peptide
PAAYAAQGYKVLVLNPSVAA

SEQ ID NO: 1019 - protein, 15 aa, Artificial Sequence
  Description of Artificial Sequence: Synthetic hybrid peptide
AQGYKVLVLNPSVAA

SEQ ID NO: 1020 - protein, 14 aa, Artificial Sequence
  Description of Artificial Sequence: Synthetic hybrid peptide
  MOD_RES (5)..(5): Ava
LRMKXVLNPSVAAT

SEQ ID NO: 1021 - protein, 13 aa, Artificial Sequence
  Description of Artificial Sequence: Synthetic hybrid peptide
  MOD_RES (5)..(5): Ava
LRMKXLNPSVAAT

SEQ ID NO: 1022 - protein, 12 aa, Artificial Sequence
  Description of Artificial Sequence: Synthetic hybrid peptide
  MOD_RES (5)..(5): Ava
LRMKXNPSVAAT

SEQ ID NO: 1023 - protein, 15 aa, Artificial Sequence
  Description of Artificial Sequence: Synthetic hybrid peptide
GYKVLVLNPSVAATL

SEQ ID NO: 1024 - protein, 19 aa, Artificial Sequence
  Description of Artificial Sequence: Synthetic hybrid peptide
  MOD_RES (5)..(5): Ava
LRLKXGYKVLVLNPSVAAT

SEQ ID NO: 1025 - protein, 18 aa, Artificial Sequence
  Description of Artificial Sequence: Synthetic hybrid peptide
  MOD_RES (5)..(5): Ava
LRLKXYKVLVLNPSVAAT

SEQ ID NO: 1026 - protein, 17 aa, Artificial Sequence
  Description of Artificial Sequence: Synthetic hybrid peptide
  MOD_RES (5)..(5): Ava
LRLKXKVLVLNPSVAAT

SEQ ID NO: 1027 - protein, 16 aa, Artificial Sequence
  Description of Artificial Sequence: Synthetic hybrid peptide
  MOD_RES (5)..(5): Ava
LRLKXVLVLNPSVAAT

SEQ ID NO: 1028 - protein, 15 aa, Artificial Sequence
  Description of Artificial Sequence: Synthetic hybrid peptide
  MOD_RES (5)..(5): Ava
LRLKXLVLNPSVAAT

SEQ ID NO: 1029 - protein, 14 aa, Artificial Sequence
  Description of Artificial Sequence: Synthetic hybrid peptide
GYKVLVLNPSVAAT

SEQ ID NO: 1030 - protein, 11 aa, Artificial Sequence
  Description of Artificial Sequence: Synthetic hybrid peptide
VLVLNPSVAAT

SEQ ID NO: 1031 - protein, 18 aa, Artificial Sequence
  Description of Artificial Sequence: Synthetic hybrid peptide
  MOD_RES (5)..(5): Ava
LRMKXNCDVGYEVIGASY

SEQ ID NO: 1032 - protein, 18 aa, Artificial Sequence
  Description of Artificial Sequence: Synthetic hybrid peptide
  MOD_RES (5)..(5): Ava
LRMKXYSTCTVPTMNNAK

SEQ ID NO: 1033 - protein, 18 aa, Artificial Sequence
  Description of Artificial Sequence: Synthetic hybrid peptide
  MOD_RES (5)..(5): Ava
LRMKXCTANSWNVIPSCQ

SEQ ID NO: 1034 - protein, 18 aa, Artificial Sequence
  Description of Artificial Sequence: Synthetic hybrid peptide
  MOD_RES (5)..(5): Ava
LRMKXNDKQKVTFTCDQG

SEQ ID NO: 1035 - protein, 18 aa, Artificial Sequence
  Description of Artificial Sequence: Synthetic hybrid peptide
  MOD_RES (5)..(5): Ava
LRMKXYSFGEYITINCDV

SEQ ID NO: 1036 - protein, 18 aa, Artificial Sequence
  Description of Artificial Sequence: Synthetic hybrid peptide
  MOD_RES (5)..(5): Ava
LRMKXKEKYSFGEYITIN

SEQ ID NO: 1037 - protein, 18 aa, Artificial Sequence
  Description of Artificial Sequence: Synthetic hybrid peptide
  MOD_RES (5)..(5): Ava
LRMKXTCDQGYHSLDPNA

SEQ ID NO: 1038 - protein, 18 aa, Artificial Sequence
  Description of Artificial Sequence: Synthetic hybrid peptide
  MOD_RES (5)..(5): Ava
LRMKXLDPNAVCETDKWK

SEQ ID NO: 1039 - protein, 18 aa, Artificial Sequence
  Description of Artificial Sequence: Synthetic hybrid peptide
  MOD_RES (5)..(5): Ava
LRMKXLYDKPLYEVNSTM

SEQ ID NO: 1040 - protein, 18 aa, Artificial Sequence
  Description of Artificial Sequence: Synthetic hybrid peptide
  MOD_RES (5)..(5): Ava
LRMKXYDKPLYEVNSTMT

SEQ ID NO: 1041 - protein, 18 aa, Artificial Sequence
  Description of Artificial Sequence: Synthetic hybrid peptide
  MOD_RES (5)..(5): Ava
LRMKXDDETDLSKLSKDV

SEQ ID NO: 1042 - protein, 18 aa, Artificial Sequence
  Description of Artificial Sequence: Synthetic hybrid peptide
  MOD_RES (5)..(5): Ava
LRMKXVLPAVVYSTCTVP

SEQ ID NO: 1043 - protein, 18 aa, Artificial Sequence
  Description of Artificial Sequence: Synthetic hybrid peptide
  MOD_RES (5)..(5): Ava
LRMKXCIDGKWNPILPTC

SEQ ID NO: 1044 - protein, 18 aa, Artificial Sequence
  Description of Artificial Sequence: Synthetic hybrid peptide
  MOD_RES (5)..(5): Ava
LRMKXNSTMTLSCNGETK

SEQ ID NO: 1045 - protein, 18 aa, Artificial Sequence
  Description of Artificial Sequence: Synthetic hybrid peptide
  MOD_RES (5)..(5): Ava
LRMKXQQKCDMPSLSNGL

SEQ ID NO: 1046 - protein, 18 aa, Artificial Sequence
  Description of Artificial Sequence: Synthetic hybrid peptide
  MOD_RES (5)..(5): Ava
LRMKXNGNTSWNDTVTCP

SEQ ID NO: 1047 - protein, 18 aa, Artificial Sequence
  Description of Artificial Sequence: Synthetic hybrid peptide
  MOD_RES (5)..(5): Ava
LRMKXVTFTCDQGYHSLD

SEQ ID NO: 1048 - protein, 18 aa, Artificial Sequence
  Description of Artificial Sequence: Synthetic hybrid peptide
  MOD_RES (5)..(5): Ava
LRMKXSCKSGFILTGSPS

SEQ ID NO: 1049 - protein, 18 aa, Artificial Sequence
  Description of Artificial Sequence: Synthetic hybrid peptide
  MOD_RES (5)..(5): Ava
LRMKXKKMCTVSDYVSEL

SEQ ID NO: 1050 - protein, 18 aa, Artificial Sequence
  Description of Artificial Sequence: Synthetic hybrid peptide
  MOD_RES (5)..(5): Ava
LRMKXFDPVDDGPDDETD

SEQ ID NO: 1051 - protein, 18 aa, Artificial Sequence
  Description of Artificial Sequence: Synthetic hybrid peptide
  MOD_RES (5)..(5): Ava
LRMKXKQKVTFTCDQGYH

SEQ ID NO: 1052 - protein, 18 aa, Artificial Sequence
  Description of Artificial Sequence: Synthetic hybrid peptide
  MOD_RES (5)..(5): Ava
LRMKXPSSTCIDGKWNPI

SEQ ID NO: 1053 - protein, 18 aa, Artificial Sequence
  Description of Artificial Sequence: Synthetic hybrid peptide
  MOD_RES (5)..(5): Ava
LRMKXMNNAKLTSTETSF

SEQ ID NO: 1054 - protein, 18 aa, Artificial Sequence
  Description of Artificial Sequence: Synthetic hybrid peptide
  MOD_RES (5)..(5): Ava
LRMKXSTETSFNDKQKVT

SEQ ID NO: 1055 - protein, 9 aa, SARS coronavirus
FLITGVFDI

SEQ ID NO: 1056 - protein, 9 aa, SARS coronavirus
MVIVNAANI

SEQ ID NO: 1057 - protein, 9 aa, SARS coronavirus
LLQHANLES

SEQ ID NO: 1058 - protein, 9 aa, SARS coronavirus
FVMMSAPPA

SEQ ID NO: 1059 - protein, 9 aa, SARS coronavirus
YVFTLLFQL

SEQ ID NO: 1060 - protein, 9 aa, SARS coronavirus
WLLLLSICL

SEQ ID NO: 1061 - protein, 9 aa, SARS coronavirus
YKLDLTILG

SEQ ID NO: 1062 - protein, 9 aa, SARS coronavirus
VRMYIFFAS

SEQ ID NO: 1063 - protein, 9 aa, SARS coronavirus
FVNLDNLRA

SEQ ID NO: 1064 - protein, 9 aa, SARS coronavirus
LMLKATLLC

SEQ ID NO: 1065 - protein, 9 aa, SARS coronavirus
YVLMDGSII

SEQ ID NO: 1066 - protein, 9 aa, SARS coronavirus
FLMSFTILC

SEQ ID NO: 1067 - protein, 9 aa, SARS coronavirus
YVFCISLKH

SEQ ID NO: 1068 - protein, 9 aa, SARS coronavirus
YLRKRVMFN

SEQ ID NO: 1069 - protein, 9 aa, SARS coronavirus
MRIMTWLEL

SEQ ID NO: 1070 - protein, 9 aa, SARS coronavirus
LVLLILMTA

SEQ ID NO: 1071 - protein, 9 aa, SARS coronavirus
FRYMNSQGL

SEQ ID NO: 1072 - protein, 9 aa, SARS coronavirus
VVLLSVLQQ

SEQ ID NO: 1073 - protein, 9 aa, SARS coronavirus
MVSLLSVLL

SEQ ID NO: 1074 - protein, 9 aa, SARS coronavirus
FIFLLFLTL

SEQ ID NO: 1075 - protein, 9 aa, SARS coronavirus
IFRSDTLYL

SEQ ID NO: 1076 - protein, 9 aa, SARS coronavirus
INNSTNVVI

SEQ ID NO: 1077 - protein, 9 aa, SARS coronavirus
VVIRACNFE

SEQ ID NO: 1078 - protein, 9 aa, SARS coronavirus
YKGYQPIDV

SEQ ID NO: 1079 - protein, 9 aa, SARS coronavirus
FRAILTAFS

SEQ ID NO: 1080 - protein, 9 aa, SARS coronavirus
FRVVPSGDV

SEQ ID NO: 1081 - protein, 9 aa, SARS coronavirus
VLYNSTFFS

SEQ ID NO: 1082 - protein, 9 aa, SARS coronavirus
VKGDDVRQI

SEQ ID NO: 1083 - protein, 9 aa, SARS coronavirus
YRYLRHGKL

SEQ ID NO: 1084 - protein, 9 aa, SARS coronavirus
MQMAYRFNG

SEQ ID NO: 1085 - protein, 9 aa, SARS coronavirus
VVNQNAQAL

SEQ ID NO: 1086 - protein, 9 aa, SARS coronavirus
IRASANLAA

SEQ ID NO: 1087 - protein, 9 aa, SARS coronavirus
VVFLHVTYV

SEQ ID NO: 1088 - protein, 9 aa, SARS coronavirus
FVFNGTSWF

SEQ ID NO: 1089 - protein, 9 aa, SARS coronavirus
VIGIINNTV

SEQ ID NO: 1090 - protein, 9 aa, SARS coronavirus
IVMVTILLC

SEQ ID NO: 1091 - protein, 9 aa, SARS coronavirus
YRRATRRVR

SEQ ID NO: 1092 - protein, 9 aa, SARS coronavirus
LLLLDRLNQ

SEQ ID NO: 1093 - protein, 9 aa, SARS coronavirus
FFGMSRIGM

SEQ ID NO: 1094 - protein, 19 aa, Artificial Sequence
  Description of Artificial Sequence: Synthetic hybrid peptide
  MOD_RES (5)..(5): Ava
LRMKXILKFLITGVFDIVK

SEQ ID NO: 1095 - protein, 19 aa, Artificial Sequence
  Description of Artificial Sequence: Synthetic hybrid peptide
  MOD_RES (5)..(5): Ava
LRMKXANPMVIVNAANIHL

SEQ ID NO: 1096 - protein, 19 aa, Artificial Sequence
  Description of Artificial Sequence: Synthetic hybrid peptide
  MOD_RES (5)..(5): Ava
LRMKXMTHLLQHANLESAK

SEQ ID NO: 1097 - protein, 19 aa, Artificial Sequence
  Description of Artificial Sequence: Synthetic hybrid peptide
  MOD_RES (5)..(5): Ava
LRMKXESSFVMMSAPPAEY

SEQ ID NO: 1098 - protein, 19 aa, Artificial Sequence
  Description of Artificial Sequence: Synthetic hybrid peptide
  MOD_RES (5)..(5): Ava
LRMKXYMPYVFTLLFQLCT

SEQ ID NO: 1099 - protein, 19 aa, Artificial Sequence
  Description of Artificial Sequence: Synthetic hybrid peptide
  MOD_RES (5)..(5): Ava
LRMKXIAMWLLLLSICLGS

SEQ ID NO: 1100 - protein, 19 aa, Artificial Sequence
  Description of Artificial Sequence: Synthetic hybrid peptide
  MOD_RES (5)..(5): Ava
LRMKXISSYKLDLTILGLA

SEQ ID NO: 1101 - protein, 19 aa, Artificial Sequence
  Description of Artificial Sequence: Synthetic hybrid peptide
  MOD_RES (5)..(5): Ava
LRMKXSAMVRMYIFFASFY

SEQ ID NO: 1102 - protein, 19 aa, Artificial Sequence
  Description of Artificial Sequence: Synthetic hybrid peptide
  MOD_RES (5)..(5): Ava
LRMKXLSHFVNLDNLRANN

SEQ ID NO: 1103 - protein, 19 aa, Artificial Sequence
  Description of Artificial Sequence: Synthetic hybrid peptide
  MOD_RES (5)..(5): Ava
LRMKXCFKLMLKATLLCVL

SEQ ID NO: 1104 - protein, 19 aa, Artificial Sequence
  Description of Artificial Sequence: Synthetic hybrid peptide
  MOD_RES (5)..(5): Ava
LRMKXDTRYVLMDGSIIQF

SEQ ID NO: 1105 - protein, 19 aa, Artificial Sequence
  Description of Artificial Sequence: Synthetic hybrid peptide
  MOD_RES (5)..(5): Ava
LRMKXALLFLMSFTILCLV

SEQ ID NO: 1106 - protein, 19 aa, Artificial Sequence
  Description of Artificial Sequence: Synthetic hybrid peptide
  MOD_RES (5)..(5): Ava
LRMKXTAIYVFCISLKHCH

SEQ ID NO: 1107 - protein, 19 aa, Artificial Sequence
  Description of Artificial Sequence: Synthetic hybrid peptide
  MOD_RES (5)..(5): Ava
LRMKXFNNYLRKRVMFNGV

SEQ ID NO: 1108 - protein, 19 aa, Artificial Sequence
  Description of Artificial Sequence: Synthetic hybrid peptide
  MOD_RES (5)..(5): Ava
LRMKXSWVMRIMTWLELAD

SEQ ID NO: 1109 - protein, 19 aa, Artificial Sequence
  Description of Artificial Sequence: Synthetic hybrid peptide
  MOD_RES (5)..(5): Ava
LRMKXASALVLLILMTART

SEQ ID NO: 1110 - protein, 19 aa, Artificial Sequence
  Description of Artificial Sequence: Synthetic hybrid peptide
  MOD_RES (5)..(5): Ava
LRMKXFCLLNRYFRLTLGV

SEQ ID NO: 1111 - protein, 19 aa, Artificial Sequence
  Description of Artificial Sequence: Synthetic hybrid peptide
  MOD_RES (5)..(5): Ava
LRMKXTQEFRYMNSQGLLP

SEQ ID NO: 1112 - protein, 19 aa, Artificial Sequence
  Description of Artificial Sequence: Synthetic hybrid peptide
  MOD_RES (5)..(5): Ava
LRMKXCTSVVLLSVLQQLR

SEQ ID NO: 1113 - protein, 19 aa, Artificial Sequence
  Description of Artificial Sequence: Synthetic hybrid peptide
  MOD_RES (5)..(5): Ava
LRMKXFEKMVSLLSVLLSM

SEQ ID NO: 1114 - protein, 19 aa, Artificial Sequence
  Description of Artificial Sequence: Synthetic hybrid peptide
  MOD_RES (5)..(5): Ava
LRMKXMFIFLLFLTLTSGS

SEQ ID NO: 1115 - protein, 19 aa, Artificial Sequence
  Description of Artificial Sequence: Synthetic hybrid peptide
  MOD_RES (5)..(5): Ava
LRMKXPDEIFRSDTLYLTQ

SEQ ID NO: 1116 - protein, 19 aa, Artificial Sequence
  Description of Artificial Sequence: Synthetic hybrid peptide
  MOD_RES (5)..(5): Ava
LRMKXVIIINNSTNVVIRA

SEQ ID NO: 1117 - protein, 19 aa, Artificial Sequence
  Description of Artificial Sequence: Synthetic hybrid peptide
  MOD_RES (5)..(5): Ava
LRMKXSTNVVIRACNFELC

SEQ ID NO: 1118 - protein, 19 aa, Artificial Sequence
  Description of Artificial Sequence: Synthetic hybrid peptide
  MOD_RES (5)..(5): Ava
LRMKXLYVYKGYQPIDVVR

SEQ ID NO: 1119 - protein, 19 aa, Artificial Sequence
  Description of Artificial Sequence: Synthetic hybrid peptide
  MOD_RES (5)..(5): Ava
LRMKXTNEFRAILTAFSPA

SEQ ID NO: 1120 - protein, 19 aa, Artificial Sequence
  Description of Artificial Sequence: Synthetic hybrid peptide
  MOD_RES (5)..(5): Ava
LRMKXTSNFRVVPSGDVVR

SEQ ID NO: 1121 - protein, 19 aa, Artificial Sequence
  Description of Artificial Sequence: Synthetic hybrid peptide
  MOD_RES (5)..(5): Ava
LRMKXDYSVLYNSTFFSTF

SEQ ID NO: 1122 - protein, 19 aa, Artificial Sequence
  Description of Artificial Sequence: Synthetic hybrid peptide
  MOD_RES (5)..(5): Ava
LRMKXSFVVKGDDVRQIAP

SEQ ID NO: 1123 - protein, 19 aa, Artificial Sequence
  Description of Artificial Sequence: Synthetic hybrid peptide
  MOD_RES (5)..(5): Ava
LRMKXNYKYRYLRHGKLRP

SEQ ID NO: 1124 - protein, 19 aa, Artificial Sequence
  Description of Artificial Sequence: Synthetic hybrid peptide
  MOD_RES (5)..(5): Ava
LRMKXPFAMQMAYRFNGIG

SEQ ID NO: 1125 - protein, 19 aa, Artificial Sequence
  Description of Artificial Sequence: Synthetic hybrid peptide
  MOD_RES (5)..(5): Ava
LRMKXLQDVVNQNAQALNT

SEQ ID NO: 1126 - protein, 19 aa, Artificial Sequence
  Description of Artificial Sequence: Synthetic hybrid peptide
  MOD_RES (5)..(5): Ava
LRMKXAAEIRASANLAATK

SEQ ID NO: 1127 - protein, 19 aa, Artificial Sequence
  Description of Artificial Sequence: Synthetic hybrid peptide
  MOD_RES (5)..(5): Ava
LRMKXPHGVVFLHVTYVPS

SEQ ID NO: 1128 - protein, 19 aa, Artificial Sequence
  Description of Artificial Sequence: Synthetic hybrid peptide
  MOD_RES (5)..(5): Ava
LRMKXEGVFVFNGTSWFIT

SEQ ID NO: 1129 - protein, 19 aa, Artificial Sequence
  Description of Artificial Sequence: Synthetic hybrid peptide
  MOD_RES (5)..(5): Ava
LRMKXCDVVIGIINNTVYD

SEQ ID NO: 1130 - protein, 19 aa, Artificial Sequence
  Description of Artificial Sequence: Synthetic hybrid peptide
  MOD_RES (5)..(5): Ava
LRMKXLIAIVMVTILLCCM

SEQ ID NO: 1131 - protein, 19 aa, Artificial Sequence
  Description of Artificial Sequence: Synthetic hybrid peptide
  MOD_RES (5)..(5): Ava
LRMKXQIGYRRATRRVRGG

SEQ ID NO: 1132 - protein, 19 aa, Artificial Sequence
  Description of Artificial Sequence: Synthetic hybrid peptide
  MOD_RES (5)..(5): Ava
LRMKXALALLLLDRLNQLE

SEQ ID NO: 1133 - protein, 19 aa, Artificial Sequence
  Description of Artificial Sequence: Synthetic hybrid peptide
  MOD_RES (5)..(5): Ava
LRMKXASAFFGMSRIGMEV

SEQ ID NO: 1134 - protein, 32 aa, Artificial Sequence
  Description of Artificial Sequence: Synthetic hybrid peptide
YPDEIFRSDTLYLTQDLFLPFYSNVTGFHTIN

SEQ ID NO: 1135 - protein, 32 aa, Artificial Sequence
  Description of Artificial Sequence: Synthetic hybrid peptide
PFKDGIYFAATEKSNVVRGWVFGSTMNNKSQS

SEQ ID NO: 1136 - protein, 32 aa, Artificial Sequence
  Description of Artificial Sequence: Synthetic hybrid peptide
KSFEIDKGIYQTSNFRVVPSGDVVRFPNITNL

SEQ ID NO: 1137 - protein, 32 aa, Artificial Sequence
  Description of Artificial Sequence: Synthetic hybrid peptide
VVRFPNITNLCPFGEVFNATKFPSVYAWERKK

SEQ ID NO: 1138 - protein, 32 aa, Artificial Sequence
  Description of Artificial Sequence: Synthetic hybrid peptide
AIHADQLTPAWRIYSTGNNVFQTQAGCLIGAE

SEQ ID NO: 1139 - protein, 32 aa, Artificial Sequence
  Description of Artificial Sequence: Synthetic hybrid peptide
FSNVYADSFVVKGDDVRQIAPGQTGVIADYNY

SEQ ID NO: 1140 - protein, 32 aa, Artificial Sequence
  Description of Artificial Sequence: Synthetic hybrid peptide
TGNYNYKYRYLRHGKLRPFERDISNVPFSPDG

SEQ ID NO: 1141 - protein, 32 aa, Artificial Sequence
  Description of Artificial Sequence: Synthetic hybrid peptide
LSFELLNAPATVCGPKLSTDLIKNQCVNFNFN

SEQ ID NO: 1142 - protein, 32 aa, Artificial Sequence
  Description of Artificial Sequence: Synthetic hybrid peptide
KNQCVNFNFNGLTGTGVLTPSSKRFQPFQQFG

SEQ ID NO: 1143 - protein, 32 aa, Artificial Sequence
  Description of Artificial Sequence: Synthetic hybrid peptide
KRFQPFQQFGRDVSDFTDSVRDPKTSEILDIS

SEQ ID NO: 1144 - protein, 32 aa, Artificial Sequence
  Description of Artificial Sequence: Synthetic hybrid peptide
PSVYAWERKKISNCVADYSVLYNSTFFSTFKC

SEQ ID NO: 1145 - protein, 32 aa, Artificial Sequence
  Description of Artificial Sequence: Synthetic hybrid peptide
GAGICASYHTVSLLRSTSQKSIVAYTMSLGAD

SEQ ID NO: 1146 - protein, 32 aa, Artificial Sequence
  Description of Artificial Sequence: Synthetic hybrid peptide
FCTQLNRALSGIAAEQDRNTREVFAQVKQMYK

SEQ ID NO: 1147 - protein, 32 aa, Artificial Sequence
  Description of Artificial Sequence: Synthetic hybrid peptide
VFAQVKQMYKTPTLKYFGGFNFSQILPDPLKP

SEQ ID NO: 1148 - protein, 32 aa, Artificial Sequence
  Description of Artificial Sequence: Synthetic hybrid peptide
GDINARDLICAQKFNGLTVLPPLLTDDMIAAY

SEQ ID NO: 1149 - protein, 32 aa, Artificial Sequence
  Description of Artificial Sequence: Synthetic hybrid peptide
SQILPDPLKPTKRSFIEDLLFNKVTLADAGFM

SEQ ID NO: 1150 - protein, 32 aa, Artificial Sequence
  Description of Artificial Sequence: Synthetic hybrid peptide
GAISSVLNDILSRLDKVEAEVQIDRLITGRLQ

SEQ ID NO: 1151 - protein, 32 aa, Artificial Sequence
  Description of Artificial Sequence: Synthetic hybrid peptide
IDLQELGKYEQYIKWPWYVWLGFIAGLIAIVM

SEQ ID NO: 1152 - protein, 32 aa, Artificial Sequence
  Description of Artificial Sequence: Synthetic hybrid peptide
SPRWYFYYLGTGPEASLPYGANKEGIVWVATE

SEQ ID NO: 1153 - protein, 32 aa, Artificial Sequence
  Description of Artificial Sequence: Synthetic hybrid peptide
KEGIVWVATEGALNTPKDHIGTRNPNNNAATV

SEQ ID NO: 1154 - protein, 568 aa, Influenza A virus
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGDFNDYEELKHLLSRINHFEKIQIIPKSSWSNHEASSGVSSACPYNGKSSFFRNVIWLIKKNSAYPTIKRSYNNTNQEDLLILWGIHHPNDAAEQTKLYQNPTTYISVGTSTLNQRLVPKIATRSKVNGQSGRMEFFWTILKPNDTINFESNGNFIAPEYAYKIVKKGDSAIMKSELEYGNCNTKCQTPMGAINSSMPFHNIHPLTIGECPKYVKSNRLVLATGLRNTPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMEGVKNGTYDYPRYSEEARLNREEISGVKLESMGTYQILSIYSTVASSLALAIMVAGLSLWMCSNGSLQCRICI

SEQ ID NO: 1155 - protein, 18 aa, Artificial Sequence
  Description of Artificial Sequence: Synthetic hybrid peptide
  MOD_RES (5)..(5): Ava
LRMKXTGMEKIVLLLAIV

SEQ ID NO: 1156 - protein, 18 aa, Artificial Sequence
  Description of Artificial Sequence: Synthetic hybrid peptide
  MOD_RES (5)..(5): Ava
LRMKXNAELLVLMENERT

SEQ ID NO: 1157 - protein, 18 aa, Artificial Sequence
  Description of Artificial Sequence: Synthetic hybrid peptide
  MOD_RES (5)..(5): Ava
LRMKXGDFNDYEELKHLL

SEQ ID NO: 1158 - protein, 18 aa, Artificial Sequence
  Description of Artificial Sequence: Synthetic hybrid peptide
  MOD_RES (5)..(5): Ava
LRMKXHAQDILEKTHNGK

SEQ ID NO: 1159 - protein, 18 aa, Artificial Sequence
  Description of Artificial Sequence: Synthetic hybrid peptide
  MOD_RES (5)..(5): Ava
LRMKXCQSGRMEFFWTIL

SEQ ID NO: 1160 - protein, 18 aa, Artificial Sequence
  Description of Artificial Sequence: Synthetic hybrid peptide
  MOD_RES (5)..(5): Ava
LRMKXTHNGKLCDLDGVK

SEQ ID NO: 1161 - protein, 18 aa, Artificial Sequence
  Description of Artificial Sequence: Synthetic hybrid peptide
  MOD_RES (5)..(5): Ava
LRMKXKPNDTINFESNGN

SEQ ID NO: 1162 - protein, 18 aa, Artificial Sequence
  Description of Artificial Sequence: Synthetic hybrid peptide
  MOD_RES (5)..(5): Ava
LRMKXKKNSAYPTIKRSY

SEQ ID NO: 1163 - protein, 18 aa, Artificial Sequence
  Description of Artificial Sequence: Synthetic hybrid peptide
  MOD_RES (5)..(5): Ava
LRMKXNSTEQVDTIMEKN

SEQ ID NO: 1164 - protein, 18 aa, Artificial Sequence
  Description of Artificial Sequence: Synthetic hybrid peptide
  MOD_RES (5)..(5): Ava
LRMKXAPEYAYKIVKKGD

SEQ ID NO: 1165 - protein, 18 aa, Artificial Sequence
  Description of Artificial Sequence: Synthetic hybrid peptide
  MOD_RES (5)..(5): Ava
LRMKXTYYQILSIYSTVA

SEQ ID NO: 1166 - protein, 18 aa, Artificial Sequence
  Description of Artificial Sequence: Synthetic hybrid peptide
  MOD_RES (5)..(5): Ava
LRMKXASSLALAIMVAGL

SEQ ID NO: 1167 - protein, 18 aa, Artificial Sequence
  Description of Artificial Sequence: Synthetic hybrid peptide
  MOD_RES (5)..(5): Ava
LRMKXVAGLSLWMCSNGS

SEQ ID NO: 1168 - protein, 18 aa, Artificial Sequence
  Description of Artificial Sequence: Synthetic hybrid peptide
  MOD_RES (5)..(5): Ava
LRMKXQNPTTYISVGTST

SEQ ID NO: 1169 - protein, 18 aa, Artificial Sequence
  Description of Artificial Sequence: Synthetic hybrid peptide
  MOD_RES (5)..(5): Ava
LRMKXTIKRSYNNTNQED

SEQ ID NO: 1170 - protein, 18 aa, Artificial Sequence
  Description of Artificial Sequence: Synthetic hybrid peptide
  MOD_RES (5)..(5): Ava
LRMKXSFFRNVIWLIKKN

SEQ ID NO: 1171 - protein, 18 aa, Artificial Sequence
  Description of Artificial Sequence: Synthetic hybrid peptide
  MOD_RES (5)..(5): Ava
LRMKXHLLSRINHFEKIQ

SEQ ID NO: 1172 - protein, 18 aa, Artificial Sequence
  Description of Artificial Sequence: Synthetic hybrid peptide
  MOD_RES (5)..(5): Ava
LRMKXKMNTQFEAVGREF

SEQ ID NO: 1173 - protein, 18 aa, Artificial Sequence
  Description of Artificial Sequence: Synthetic hybrid peptide
  MOD_RES (5)..(5): Ava
LRMKXFFRNVIWLIKKNS

SEQ ID NO: 1174 - protein, 18 aa, Artificial Sequence
  Description of Artificial Sequence: Synthetic hybrid peptide
  MOD_RES (5)..(5): Ava
LRMKXVKLESMGTYQILS

SEQ ID NO: 1175 - protein, 18 aa, Artificial Sequence
  Description of Artificial Sequence: Synthetic hybrid peptide
  MOD_RES (5)..(5): Ava
LRMKXNSSMPFHNIHPLT

SEQ ID NO: 1176 - protein, 18 aa, Artificial Sequence
  Description of Artificial Sequence: Synthetic hybrid peptide
  MOD_RES (5)..(5): Ava
LRMKXNKVNSIIDKMNTQ

SEQ ID NO: 1177 - protein, 18 aa, Artificial Sequence
  Description of Artificial Sequence: Synthetic hybrid peptide
  MOD_RES (5)..(5): Ava
LRMKXKMEDGFLDVWTYN

SEQ ID NO: 1178 - protein, 18 aa, Artificial Sequence
  Description of Artificial Sequence: Synthetic hybrid peptide
  MOD_RES (5)..(5): Ava
LRMKXMGTYQILSIYSTV

SEQ ID NO: 1179 - protein, 18 aa, Artificial Sequence
  Description of Artificial Sequence: Synthetic hybrid peptide
  MOD_RES (5)..(5): Ava
LRMKXAVGREFNNLERRI

SEQ ID NO: 1180 - protein, 18 aa, Artificial Sequence
  Description of Artificial Sequence: Synthetic hybrid peptide
  MOD_RES (5)..(5): Ava
LRMKXCYPGDFNDYEELK

SEQ ID NO: 1181 - protein, 18 aa, Artificial Sequence
  Description of Artificial Sequence: Synthetic hybrid peptide
  MOD_RES (5)..(5): Ava
LRMKXSNVKNLYDKVRLQ

SEQ ID NO: 1182 - protein, 18 aa, Artificial Sequence
  Description of Artificial Sequence: Synthetic hybrid peptide
  MOD_RES (5)..(5): Ava
LRMKXQILSIYSTVASSL

SEQ ID NO: 1183 - protein, 18 aa, Artificial Sequence
  Description of Artificial Sequence: Synthetic hybrid peptide
  MOD_RES (5)..(5): Ava
LRMKXVLLAIVSLVKSDQ

SEQ ID NO: 1184 - protein, 18 aa, Artificial Sequence
  Description of Artificial Sequence: Synthetic hybrid peptide
  MOD_RES (5)..(5): Ava
LRMKXGWQGMVDGWYGYH

SEQ ID NO: 1185 - protein, 18 aa, Artificial Sequence
  Description of Artificial Sequence: Synthetic hybrid peptide
  MOD_RES (5)..(5): Ava
LRMKXNAELLVLMENERT

SEQ ID NO: 1186 - protein, 18 aa, Artificial Sequence
  Description of Artificial Sequence: Synthetic hybrid peptide
  MOD_RES (5)..(5): Ava
LRMKXGDFNDYEELKHLL

SEQ ID NO: 1187 - protein, 18 aa, Artificial Sequence
  Description of Artificial Sequence: Synthetic hybrid peptide
  MOD_RES (5)..(5): Ava
LRMKXCQSGRMEFFWTIL

SEQ ID NO: 1188 - protein, 18 aa, Artificial Sequence
  Description of Artificial Sequence: Synthetic hybrid peptide
  MOD_RES (5)..(5): Ava
LRMKXTHNGKLCDLDGVK

SEQ ID NO: 1189 - protein, 17 aa, Artificial Sequence
  Description of Artificial Sequence: Synthetic hybrid peptide
  MOD_RES (5)..(5): Ava
LRMKXKPNDTINFENGN

SEQ ID NO: 1190 - protein, 18 aa, Artificial Sequence
  Description of Artificial Sequence: Synthetic hybrid peptide
  MOD_RES (5)..(5): Ava
LRMKXKKNSAYPTIKRSY

SEQ ID NO: 1191 - protein, 18 aa, Artificial Sequence
  Description of Artificial Sequence: Synthetic hybrid peptide
  MOD_RES (5)..(5): Ava
LRMKXNSTEQVDTIMEKN

SEQ ID NO: 1192 - protein, 18 aa, Artificial Sequence
  Description of Artificial Sequence: Synthetic hybrid peptide
  MOD_RES (5)..(5): Ava
LRMKXAPEYAYKIVKKGD

SEQ ID NO: 1193 - protein, 18 aa, Artificial Sequence
  Description of Artificial Sequence: Synthetic hybrid peptide
  MOD_RES (5)..(5): Ava
LRMKXTYYQILSIYSTVA

SEQ ID NO: 1194 - protein, 18 aa, Artificial Sequence
  Description of Artificial Sequence: Synthetic hybrid peptide
  MOD_RES (5)..(5): Ava
LRMKXVAGLSLWMCSNGS

SEQ ID NO: 1195 - protein, 18 aa, Artificial Sequence
  Description of Artificial Sequence: Synthetic hybrid peptide
  MOD_RES (5)..(5): Ava
LRMKXQNPTTYISVGTST

SEQ ID NO: 1196 - protein, 18 aa, Artificial Sequence
  Description of Artificial Sequence: Synthetic hybrid peptide
  MOD_RES (5)..(5): Ava
LRMKXTIKRSYNNTNQED

SEQ ID NO: 1197 - protein, 18 aa, Artificial Sequence
  Description of Artificial Sequence: Synthetic hybrid peptide
  MOD_RES (5)..(5): Ava
LRMKXSFFRNVIWLIKKN

SEQ ID NO: 1198 - protein, 18 aa, Artificial Sequence
  Description of Artificial Sequence: Synthetic hybrid peptide
  MOD_RES (5)..(5): Ava
LRMKXHLLSRINHFEKIQ

SEQ ID NO: 1199 - protein, 18 aa, Artificial Sequence
  Description of Artificial Sequence: Synthetic hybrid peptide
  MOD_RES (5)..(5): Ava
LRMKXKMNTQFEAVGREF

SEQ ID NO: 1200 - protein, 18 aa, Artificial Sequence
  Description of Artificial Sequence: Synthetic hybrid peptide
  MOD_RES (5)..(5): Ava
LRMKXVKLESMGTYQILS

SEQ ID NO: 1201 - protein, 18 aa, Artificial Sequence
  Description of Artificial Sequence: Synthetic hybrid peptide
  MOD_RES (5)..(5): Ava
LRMKXNSSMPFHNIHPLT

SEQ ID NO: 1202 - protein, 18 aa, Artificial Sequence
  Description of Artificial Sequence: Synthetic hybrid peptide
  MOD_RES (5)..(5): Ava
LRMKXNKVNSIIDKMNTQ

SEQ ID NO: 1203 - protein, 18 aa, Artificial Sequence
  Description of Artificial Sequence: Synthetic hybrid peptide
  MOD_RES (5)..(5): Ava
LRMKXKMEDGFLDVWTYN

SEQ ID NO: 1204 - protein, 18 aa, Artificial Sequence
  Description of Artificial Sequence: Synthetic hybrid peptide
  MOD_RES (5)..(5): Ava
LRMKXMGTYQILSIYSTV

SEQ ID NO: 1205 - protein, 18 aa, Artificial Sequence
  Description of Artificial Sequence: Synthetic hybrid peptide
  MOD_RES (5)..(5): Ava
LRMKXAVGREFNNLERRI

SEQ ID NO: 1206 - protein, 18 aa, Artificial Sequence
  Description of Artificial Sequence: Synthetic hybrid peptide
  MOD_RES (5)..(5): Ava
LRMKXCYPGDFNDYEELK

SEQ ID NO: 1207 - protein, 18 aa, Artificial Sequence
  Description of Artificial Sequence: Synthetic hybrid peptide
  MOD_RES (5)..(5): Ava
LRMKXSNVKNLYDKVRLQ

SEQ ID NO: 1208 - protein, 18 aa, Artificial Sequence
  Description of Artificial Sequence: Synthetic hybrid peptide
  MOD_RES (5)..(5): Ava
LRMKXGWQGMVDGWYGYH

SEQ ID NO: 1209 - protein, 564 aa, Influenza A virus
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRIC

SEQ ID NO: 1210 - protein, 21 aa, Artificial Sequence
  Description of Artificial Sequence: Synthetic hybrid peptide
  MOD_RES (5)..(5): Ava
LRMKXTVASSLVLLVSLGAIS

SEQ ID NO: 1211 - protein, 18 aa, Artificial Sequence
  Description of Artificial Sequence: Synthetic hybrid peptide
  MOD_RES (5)..(5): Ava
LRMKXSVAGWILGNPECE

SEQ ID NO: 1212 - protein, 21 aa, Artificial Sequence
  Description of Artificial Sequence: Synthetic hybrid peptide
  MOD_RES (5)..(5): Ava
LRMKXSSFERFEIFPKESSWP

SEQ ID NO: 1213 - protein, 18 aa, Artificial Sequence
  Description of Artificial Sequence: Synthetic hybrid peptide
  MOD_RES (5)..(5): Ava
LRMKXVLEKNVTVTHSVN

SEQ ID NO: 1214 - protein, 18 aa, Artificial Sequence
  Description of Artificial Sequence: Synthetic hybrid peptide
  MOD_RES (5)..(5): Ava
LRMKXKMNTQFTAVGKEF

SEQ ID NO: 1215 - protein, 18 aa, Artificial Sequence
  Description of Artificial Sequence: Synthetic hybrid peptide
  MOD_RES (5)..(5): Ava
LRMKXANGNLIAPWYAFA

SEQ ID NO: 1216 - protein, 18 aa, Artificial Sequence
  Description of Artificial Sequence: Synthetic hybrid peptide
  MOD_RES (5)..(5): Ava
LRMKXSSLVLLVSLGAIS

SEQ ID NO: 1217 - protein, 18 aa, Artificial Sequence
  Description of Artificial Sequence: Synthetic hybrid peptide
  MOD_RES (5)..(5): Ava
LRMKXFYRNLLWLTGKNG

SEQ ID NO: 1218 - protein, 18 aa, Artificial Sequence
  Description of Artificial Sequence: Synthetic hybrid peptide
  MOD_RES (5)..(5): Ava
LRMKXKVDDGFLDIWTYN

SEQ ID NO: 1219 - protein, 18 aa, Artificial Sequence
  Description of Artificial Sequence: Synthetic hybrid peptide
  MOD_RES (5)..(5): Ava
LRMKXAKLLVLLCTFTAT

SEQ ID NO: 1220 - protein, 18 aa, Artificial Sequence
  Description of Artificial Sequence: Synthetic hybrid peptide
  MOD_RES (5)..(5): Ava
LRMKXAVGKEFNKLERRM

SEQ ID NO: 1221 - protein, 21 aa, Artificial Sequence
  Description of Artificial Sequence: Synthetic hybrid peptide
  MOD_RES (5)..(5): Ava
LRMKXGVYQILAIYSTVASSL

SEQ ID NO: 1222 - protein, 18 aa, Artificial Sequence
  Description of Artificial Sequence: Synthetic hybrid peptide
  MOD_RES (5)..(5): Ava
LRMKXSHNGKLCLLKGIA

SEQ ID NO: 1223 - protein, 18 aa, Artificial Sequence
  Description of Artificial Sequence: Synthetic hybrid peptide
  MOD_RES (5)..(5): Ava
LRMKXVHHPPNIGDQRAL

SEQ ID NO: 1224 - protein, 18 aa, Artificial Sequence
  Description of Artificial Sequence: Synthetic hybrid peptide
  MOD_RES (5)..(5): Ava
LRMKXNVKNLYEKVKSQL

SEQ ID NO: 1225 - protein, 18 aa, Artificial Sequence
  Description of Artificial Sequence: Synthetic hybrid peptide
  MOD_RES (5)..(5): Ava
LRMKXGDQRALYHTENAY

SEQ ID NO: 1226 - protein, 18 aa, Artificial Sequence
  Description of Artificial Sequence: Synthetic hybrid peptide
  MOD_RES (5)..(5): Ava
LRMKXSSFERFEIFPKES

SEQ ID NO: 1227 - protein, 18 aa, Artificial Sequence
  Description of Artificial Sequence: Synthetic hybrid peptide
  MOD_RES (5)..(5): Ava
LRMKXEQLSSVSSFERFE

SEQ ID NO: 1228 - protein, 18 aa, Artificial Sequence
  Description of Artificial Sequence: Synthetic hybrid peptide
  MOD_RES (5)..(5): Ava
LRMKXMKAKLLVLLCTFT

SEQ ID NO: 1229 - protein, 18 aa, Artificial Sequence
  Description of Artificial Sequence: Synthetic hybrid peptide
  MOD_RES (5)..(5): Ava
LRMKXNAELLVLLENERT

SEQ ID NO: 1230 - protein, 18 aa, Artificial Sequence
  Description of Artificial Sequence: Synthetic hybrid peptide
  MOD_RES (5)..(5): Ava
LRMKXQILAIYSTVASSL

SEQ ID NO: 1231 - protein, 18 aa, Artificial Sequence
  Description of Artificial Sequence: Synthetic hybrid peptide
  MOD_RES (5)..(5): Ava
LRMKXLIAPWYAFALSRG

SEQ ID NO: 1232 - protein, 18 aa, Artificial Sequence
  Description of Artificial Sequence: Synthetic hybrid peptide
  MOD_RES (5)..(5): Ava
LRMKXGKNGLYPNLSKSY

SEQ ID NO: 1233 - protein, 18 aa, Artificial Sequence
  Description of Artificial Sequence: Synthetic hybrid peptide
  MOD_RES (5)..(5): Ava
LRMKXDQEGRINYYWTLL

SEQ ID NO: 1234 - protein, 18 aa, Artificial Sequence
  Description of Artificial Sequence: Synthetic hybrid peptide
  MOD_RES (5)..(5): Ava
LRMKXWPNHTVTGVSASC

SEQ ID NO: 1235 - protein, 18 aa, Artificial Sequence
  Description of Artificial Sequence: Synthetic hybrid peptide
  MOD_RES (5)..(5): Ava
LRMKXEPGDTIIFEANGN

SEQ ID NO: 1236 - protein, 18 aa, Artificial Sequence
  Description of Artificial Sequence: Synthetic hybrid peptide
  MOD_RES (5)..(5): Ava
LRMKXTGLRNIPSIQSRG

SEQ ID NO: 1237 - protein, 18 aa, Artificial Sequence
  Description of Artificial Sequence: Synthetic hybrid peptide
  MOD_RES (5)..(5): Ava
LRMKXGYFADYEELREQL

SEQ ID NO: 1238 - protein, 18 aa, Artificial Sequence
  Description of Artificial Sequence: Synthetic hybrid peptide
  MOD_RES (5)..(5): Ava
LRMKXVKLESMGVYQILA

SEQ ID NO: 1239 - protein, 18 aa, Artificial Sequence
  Description of Artificial Sequence: Synthetic hybrid peptide
  MOD_RES (5)..(5): Ava
LRMKXNKVNSVIEKMNTQ

SEQ ID NO: 1240 - protein, 18 aa, Artificial Sequence
  Description of Artificial Sequence: Synthetic hybrid peptide
  MOD_RES (5)..(5): Ava
LRMKXTHSVNLLEDSHNG

SEQ ID NO: 1241 - protein, 18 aa, Artificial Sequence
  Description of Artificial Sequence: Synthetic hybrid peptide
  MOD_RES (5)..(5): Ava
LRMKXHSVNLLEDSHNGK

SEQ ID NO: 1242 - protein, 18 aa, Artificial Sequence
  Description of Artificial Sequence: Synthetic hybrid peptide
  MOD_RES (5)..(5): Ava
LRMKXGKSSFYRNLLWLT

SEQ ID NO: 1243 - protein, 18 aa, Artificial Sequence
  Description of Artificial Sequence: Synthetic hybrid peptide
  MOD_RES (5)..(5): Ava
LRMKXKLLVLLCTFTATY

SEQ ID NO: 1244 - protein, 566 aa, Influenza A virus
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEEMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 1245 - protein, 19 aa, Artificial Sequence
  Description of Artificial Sequence: Synthetic hybrid peptide
  MOD_RES (5)..(5): Ava
LRMKXSRISIYWTIVKPGD

SEQ ID NO: 1246 - protein, 18 aa, Artificial Sequence
  Description of Artificial Sequence: Synthetic hybrid peptide
  MOD_RES (5)..(5): Ava
LRMKXYPVLNVTMPNNDN

SEQ ID NO: 1247 - protein, 21 aa, Artificial Sequence
  Description of Artificial Sequence: Synthetic hybrid peptide
  MOD_RES (5)..(5): Ava
LRMKXCYPYDVPDYASLRSLV

SEQ ID NO: 1248 - protein, 18 aa, Artificial Sequence
  Description of Artificial Sequence: Synthetic hybrid peptide
  MOD_RES (5)..(5): Ava
LRMKXNATELVQSSSTGK

SEQ ID NO: 1249 - protein, 18 aa, Artificial Sequence
  Description of Artificial Sequence: Synthetic hybrid peptide
  MOD_RES (5)..(5): Ava
LRMKXKTNEKFHQIEKEF

SEQ ID NO: 1250 - protein, 18 aa, Artificial Sequence
  Description of Artificial Sequence: Synthetic hybrid peptide
  MOD_RES (5)..(5): Ava
LRMKXCYPYDVPDYASLR

SEQ ID NO: 1251 - protein, 18 aa, Artificial Sequence
  Description of Artificial Sequence: Synthetic hybrid peptide
  MOD_RES (5)..(5): Ava
LRMKXGACPKYVKQNTLK

SEQ ID NO: 1252 - protein, 19 aa, Artificial Sequence
  Description of Artificial Sequence: Synthetic hybrid peptide
  MOD_RES (5)..(5): Ava
LRMKXVKPGDVLVINSNGN

SEQ ID NO: 1253 - protein, 21 aa, Artificial Sequence
  Description of Artificial Sequence: Synthetic hybrid peptide
  MOD_RES (5)..(5): Ava
LRMKXGWEGMIDGWYGFRHQN

SEQ ID NO: 1254 - protein, 18 aa, Artificial Sequence
  Description of Artificial Sequence: Synthetic hybrid peptide
  MOD_RES (5)..(5): Ava
LRMKXDWILWISFAISCF

SEQ ID NO: 1255 - protein, 18 aa, Artificial Sequence
  Description of Artificial Sequence: Synthetic hybrid peptide
  MOD_RES (5)..(5): Ava
LRMKXGFFSRLNWLTKSG

SEQ ID NO: 1256 - protein, 18 aa, Artificial Sequence
  Description of Artificial Sequence: Synthetic hybrid peptide
  MOD_RES (5)..(5): Ava
LRMKXGLSSRISIYWTIV

SEQ ID NO: 1257 - protein, 19 aa, Artificial Sequence
  Description of Artificial Sequence: Synthetic hybrid peptide
  MOD_RES (5)..(5): Ava
LRMKXIGSRPWVRGLSSRI

SEQ ID NO: 1258 - protein, 18 aa, Artificial Sequence
  Description of Artificial Sequence: Synthetic hybrid peptide
  MOD_RES (5)..(5): Ava
LRMKXGKLNRVIEKTNEK

SEQ ID NO: 1259 - protein, 18 aa, Artificial Sequence
  Description of Artificial Sequence: Synthetic hybrid peptide
  MOD_RES (5)..(5): Ava
LRMKXTLIDALLGDPHCD

SEQ ID NO: 1260 - protein, 18 aa, Artificial Sequence
  Description of Artificial Sequence: Synthetic hybrid peptide
  MOD_RES (5)..(5): Ava
LRMKXPNGTLVKTITDDQ

SEQ ID NO: 1261 - protein, 18 aa, Artificial Sequence
  Description of Artificial Sequence: Synthetic hybrid peptide
  MOD_RES (5)..(5): Ava
LRMKXSRISIYWTIVKPG

SEQ ID NO: 1262 - protein, 18 aa, Artificial Sequence
  Description of Artificial Sequence: Synthetic hybrid peptide
  MOD_RES (5)..(5): Ava
LRMKXGWEGMIDGWYGFR

SEQ ID NO: 1263 - protein, 18 aa, Artificial Sequence
  Description of Artificial Sequence: Synthetic hybrid peptide
  MOD_RES (5)..(5): Ava
LRMKXIAPRGYFKMRTGK

SEQ ID NO: 1264 - protein, 18 aa, Artificial Sequence
  Description of Artificial Sequence: Synthetic hybrid peptide
  MOD_RES (5)..(5): Ava
LRMKXQDLEKYVEDTKID

SEQ ID NO: 1265 - protein, 19 aa, Artificial Sequence
  Description of Artificial Sequence: Synthetic hybrid peptide
  MOD_RES (5)..(5): Ava
LRMKXNFDKLYIWGIHHPS

SEQ ID NO: 1266 - protein, 18 aa, Artificial Sequence
  Description of Artificial Sequence: Synthetic hybrid peptide
  MOD_RES (5)..(5): Ava
LRMKXSLRSLVASSGTLE

SEQ ID NO: 1267 - protein, 19 aa, Artificial Sequence
  Description of Artificial Sequence: Synthetic hybrid peptide
  MOD_RES (5)..(5): Ava
LRMKXETWDLFVERSKAFS

SEQ ID NO: 1268 - protein, 18 aa, Artificial Sequence
  Description of Artificial Sequence: Synthetic hybrid peptide
  MOD_RES (5)..(5): Ava
LRMKXDTKIDLWSYNAEL

SEQ ID NO: 1269 - protein, 18 aa, Artificial Sequence
  Description of Artificial Sequence: Synthetic hybrid peptide
  MOD_RES (5)..(5): Ava
LRMKXSEMNKLFEKTRRQ

SEQ ID NO: 1270 - protein, 18 aa, Artificial Sequence
  Description of Artificial Sequence: Synthetic hybrid peptide
  MOD_RES (5)..(5): Ava
LRMKXSQQTIIPNIGSRP

SEQ ID NO: 1271 - protein, 18 aa, Artificial Sequence
  Description of Artificial Sequence: Synthetic hybrid peptide
  MOD_RES (5)..(5): Ava
LRMKXTEGFTWTGVTQNG

SEQ ID NO: 1272 - protein, 18 aa, Artificial Sequence
  Description of Artificial Sequence: Synthetic hybrid peptide
  MOD_RES (5)..(5): Ava
LRMKXTWDLFVERSKAFS

SEQ ID NO: 1273 - protein, 18 aa, Artificial Sequence
  Description of Artificial Sequence: Synthetic hybrid peptide
  MOD_RES (5)..(5): Ava
LRMKXPNNDNFDKLYIWG

SEQ ID NO: 1274 - protein, 18 aa, Artificial Sequence
  Description of Artificial Sequence: Synthetic hybrid peptide
  MOD_RES (5)..(5): Ava
LRMKXCDNACIESIRNGT

SEQ ID NO: 1275 - protein, 18 aa, Artificial Sequence
  Description of Artificial Sequence: Synthetic hybrid peptide
  MOD_RES (5)..(5): Ava
LRMKXVKPGDVLVINSNG

SEQ ID NO: 1276 - protein, 18 aa, Artificial Sequence
  Description of Artificial Sequence: Synthetic hybrid peptide
  MOD_RES (5)..(5): Ava
LRMKXIGSRPWVRGLSSR

SEQ ID NO: 1277 - protein, 18 aa, Artificial Sequence
  Description of Artificial Sequence: Synthetic hybrid peptide
  MOD_RES (5)..(5): Ava
LRMKXNFDKLYIWGIHHP

SEQ ID NO: 1278 - protein, 18 aa, Artificial Sequence
  Description of Artificial Sequence: Synthetic hybrid peptide
  MOD_RES (5)..(5): Ava
LRMKXEFITEGFTWTGVT

SEQ ID NO: 1279 - protein, 567 aa, Influenza A virus
MNTQILAFIACMLIGTKGDKICLGHHAVANGTKVNTLTERGIEVVNATETVETVNIKKICTQGKRPTDLGQCGLLGTLIGPPQCDQFLEFDANLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATGMRNVPENPKQAYQKRMTRGLFGAIAGFIENGWEGLIDGWYGFRHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIAMGLVFICIKNGNMRCTICI

SEQ ID NO: 1280 - protein, 18 aa, Artificial Sequence
  Description of Artificial Sequence: Synthetic hybrid peptide
  MOD_RES (5)..(5): Ava
LRMKXGKCPRYVKQTSLL

SEQ ID NO: 1281 - protein, 18 aa, Artificial Sequence
  Description of Artificial Sequence: Synthetic hybrid peptide
  MOD_RES (5)..(5): Ava
LRMKXIDFHWLLLDPNDT

SEQ ID NO: 1282 - protein, 18 aa, Artificial Sequence
  Description of Artificial Sequence: Synthetic hybrid peptide
  MOD_RES (5)..(5): Ava
LRMKXCYPGKFTNEESLR

SEQ ID NO: 1283 - protein, 18 aa, Artificial Sequence
  Description of Artificial Sequence: Synthetic hybrid peptide
  MOD_RES (5)..(5): Ava
LRMKXAMGLVFICIKNGN

SEQ ID NO: 1284 - protein, 18 aa, Artificial Sequence
  Description of Artificial Sequence: Synthetic hybrid peptide
  MOD_RES (5)..(5): Ava
LRMKXTNEESLRQILRGS

SEQ ID NO: 1285 - protein, 18 aa, Artificial Sequence
  Description of Artificial Sequence: Synthetic hybrid peptide
  MOD_RES (5)..(5): Ava
LRMKXGWEGLIDGWYGFR

SEQ ID NO: 1286 - protein, 18 aa, Artificial Sequence
  Description of Artificial Sequence: Synthetic hybrid peptide
  MOD_RES (5)..(5): Ava
LRMKXSMGFTYSGIRTNG

SEQ ID NO: 1287 - protein, 18 aa, Artificial Sequence
  Description of Artificial Sequence: Synthetic hybrid peptide
  MOD_RES (5)..(5): Ava
LRMKXFNGAFIAPDRASF

SEQ ID NO: 1288 - protein, 18 aa, Artificial Sequence
  Description of Artificial Sequence: Synthetic hybrid peptide
  MOD_RES (5)..(5): Ava
LRMKXKPALIIWGVHHSG

SEQ ID NO: 1289 - protein, 18 aa, Artificial Sequence
  Description of Artificial Sequence: Synthetic hybrid peptide
  MOD_RES (5)..(5): Ava
LRMKXSGYKDIILWFSFG

SEQ ID NO: 1290 - protein, 18 aa, Artificial Sequence
  Description of Artificial Sequence: Synthetic hybrid peptide
  MOD_RES (5)..(5): Ava
LRMKXVSSLPFQNINPRT

SEQ ID NO: 1291 - protein, 18 aa, Artificial Sequence
  Description of Artificial Sequence: Synthetic hybrid peptide
  MOD_RES (5)..(5): Ava
LRMKXTGMRNVPENPKQA

SEQ ID NO: 1292 - protein, 18 aa, Artificial Sequence
  Description of Artificial Sequence: Synthetic hybrid peptide
  MOD_RES (5)..(5): Ava
LRMKXGLIDGWYGFRHQN

SEQ ID NO: 1293 - protein, 18 aa, Artificial Sequence
  Description of Artificial Sequence: Synthetic hybrid peptide
  MOD_RES (5)..(5): Ava
LRMKXYAEMKWLLSNSDN

SEQ ID NO: 1294 - protein, 18 aa, Artificial Sequence
  Description of Artificial Sequence: Synthetic hybrid peptide
  MOD_RES (5)..(5): Ava
LRMKXEMNKLYERVRKQL

SEQ ID NO: 1295 - protein, 17 aa, Artificial Sequence
  Description of Artificial Sequence: Synthetic hybrid peptide
  MOD_RES (5)..(5): Ava
LRMKXMNTQILAFIACM

SEQ ID NO: 1296 - protein, 18 aa, Artificial Sequence
  Description of Artificial Sequence: Synthetic hybrid peptide
  MOD_RES (5)..(5): Ava
LRMKXNEFSEIEQQIGNV

SEQ ID NO: 1297 - protein, 18 aa, Artificial Sequence
  Description of Artificial Sequence: Synthetic hybrid peptide
  MOD_RES (5)..(5): Ava
LRMKXQCDQFLEFDANLI

SEQ ID NO: 1298 - protein, 18 aa, Artificial Sequence
  Description of Artificial Sequence: Synthetic hybrid peptide
  MOD_RES (5)..(5): Ava
LRMKXKTNQQFELIDNEF

SEQ ID NO: 1299 - protein, 18 aa, Artificial Sequence
  Description of Artificial Sequence: Synthetic hybrid peptide
  MOD_RES (5)..(5): Ava
LRMKXTEQTKLYGSGNKL

SEQ ID NO: 1300 - protein, 18 aa, Artificial Sequence
  Description of Artificial Sequence: Synthetic hybrid peptide
  MOD_RES (5)..(5): Ava
LRMKXSDNAAFPQMTKSY

SEQ ID NO: 1301 - protein, 18 aa, Artificial Sequence
  Description of Artificial Sequence: Synthetic hybrid peptide
  MOD_RES (5)..(5): Ava
LRMKXDSMTEVWSYNAEL

SEQ ID NO: 1302 - protein, 18 aa, Artificial Sequence
  Description of Artificial Sequence: Synthetic hybrid peptide
  MOD_RES (5)..(5): Ava
LRMKXNDTVTFTFNGAFI

SEQ ID NO: 1303 - protein, 18 aa, Artificial Sequence
  Description of Artificial Sequence: Synthetic hybrid peptide
  MOD_RES (5)..(5): Ava
LRMKXEMKWLLSNSDNAA

SEQ ID NO: 1304 - protein, 18 aa, Artificial Sequence
  Description of Artificial Sequence: Synthetic hybrid peptide
  MOD_RES (5)..(5): Ava
LRMKXDPNDTVTFTFNGA

SEQ ID NO: 1305 - protein, 18 aa, Artificial Sequence
  Description of Artificial Sequence: Synthetic hybrid peptide
  MOD_RES (5)..(5): Ava
LRMKXPQCDQFLEFDANL

SEQ ID NO: 1306 - protein, 18 aa, Artificial Sequence
  Description of Artificial Sequence: Synthetic hybrid peptide
  MOD_RES (5)..(5): Ava
LRMKXNPKQAYQKRMTRG

SEQ ID NO: 1307 - protein, 18 aa, Artificial Sequence
  Description of Artificial Sequence: Synthetic hybrid peptide
  MOD_RES (5)..(5): Ava
LRMKXVETVNIKKICTQG

SEQ ID NO: 1308 - protein, 18 aa, Artificial Sequence
  Description of Artificial Sequence: Synthetic hybrid peptide
  MOD_RES (5)..(5): Ava
LRMKXSGSSFYAEMKWLL

SEQ ID NO: 1309 - protein, 18 aa, Artificial Sequence
  Description of Artificial Sequence: Synthetic hybrid peptide
  MOD_RES (5)..(5): Ava
LRMKXRGIEVVNATETVE

SEQ ID NO: 1310 - protein, 21 aa, Artificial Sequence
  Description of Artificial Sequence: Synthetic hybrid peptide
  MOD_RES (5)..(5): Ava
LRMKXGWEGLIDGWYGFRHQN

SEQ ID NO: 1311 - protein, 20 aa, Artificial Sequence
  Description of Artificial Sequence: Synthetic hybrid peptide
  MOD_RES (5)..(5): Ava
LRMKXYAEMKWLLSNSDNAA

SEQ ID NO: 1312 - protein, 560 aa, Influenza A virus
METISLITILLVVTASNADKICIGHQSTNSTETVDTLTETNVPVTHAKELLHTEHNGMLCATSLGHPLILDTCTIEGLVYGNPSCDLLLEGREWSYIVERSSAVNGTCYPGNVENLEELRTLFSSASSYQRIQIFPDTTWNVTYTGTSRACSGSFYRSMRWLTQKSGFYPVQDAQYTNNRGKSILFVWGIHHPPTYTEQTNLYIRNDTTTSVTTEDLNRTFKPVIGPRPLVNGLQGRIDYYWSVLKPGQTLRVRSNGNLIAPWYGHVLSGGSHGRILKTDLKSGNCVVQCQTEKGGLNSTLPFHNISKYAFGTCPKYVRVNSLKLAVGLRNVPARSSRGLFGAIAGFIEGGWPGLVAGWYGFQHSNDQGVGMAADRDSTQKAIDKITSKVNNIVDKMNKQYEIIDHEFSEVETRLNMINNKIDDQIQDVWAYNAELLVLLENQKTLDEHDANVNNLYNKVKRALGSNAMEDGKGCFELYHKCDDQCMETIRNGTYNRRKYREESRLERQKIEGVKLESEGAYKILTIYSTVASSLVLAMGFAAFLFWAMSNGSCRCNICI

SEQ ID NO: 1313 - protein, 18 aa, Artificial Sequence
  Description of Artificial Sequence: Synthetic hybrid peptide
  MOD_RES (5)..(5): Ava
LRMKXDLNRTFKPVIGPR

SEQ ID NO: 1314 - protein, 18 aa, Artificial Sequence
  Description of Artificial Sequence: Synthetic hybrid peptide
  MOD_RES (5)..(5): Ava
LRMKXSHGRILKTDLKSG

SEQ ID NO: 1315 - protein, 18 aa, Artificial Sequence
  Description of Artificial Sequence: Synthetic hybrid peptide
  MOD_RES (5)..(5): Ava
LRMKXGREWSYIVERSSA

SEQ ID NO: 1316 - protein, 18 aa, Artificial Sequence
  Description of Artificial Sequence: Synthetic hybrid peptide
  MOD_RES (5)..(5): Ava
LRMKXAGWYGFQHSNDQG

SEQ ID NO: 1317 - protein, 18 aa, Artificial Sequence
  Description of Artificial Sequence: Synthetic hybrid peptide
  MOD_RES (5)..(5): Ava
LRMKXNVNNLYNKVKRAL

SEQ ID NO: 1318 - protein, 18 aa, Artificial Sequence
  Description of Artificial Sequence: Synthetic hybrid peptide
  MOD_RES (5)..(5): Ava
LRMKXGLQGRIDYYWSVL

SEQ ID NO: 1319 - protein, 18 aa, Artificial Sequence
  Description of Artificial Sequence: Synthetic hybrid peptide
  MOD_RES (5)..(5): Ava
LRMKXKLAVGLRNVPARS

SEQ ID NO: 1320 - protein, 18 aa, Artificial Sequence
  Description of Artificial Sequence: Synthetic hybrid peptide
  MOD_RES (5)..(5): Ava
LRMKXQKIEGVKLESEGA

SEQ ID NO: 1321 - protein, 18 aa, Artificial Sequence
  Description of Artificial Sequence: Synthetic hybrid peptide
  MOD_RES (5)..(5): Ava
LRMKXLIAPWYGHVLSGG

SEQ ID NO: 1322 - protein, 18 aa, Artificial Sequence
  Description of Artificial Sequence: Synthetic hybrid peptide
  MOD_RES (5)..(5): Ava
LRMKXDTTWNVTYTGTSR

SEQ ID NO: 1323 - protein, 18 aa, Artificial Sequence
  Description of Artificial Sequence: Synthetic hybrid peptide
  MOD_RES (5)..(5): Ava
LRMKXKMNKQYEIIDHEF

SEQ ID NO: 1324 - protein, 18 aa, Artificial Sequence
  Description of Artificial Sequence: Synthetic hybrid peptide
  MOD_RES (5)..(5): Ava
LRMKXGWPGLVAGWYGFQ

SEQ ID NO: 1325 - protein, 18 aa, Artificial Sequence
  Description of Artificial Sequence: Synthetic hybrid peptide
  MOD_RES (5)..(5): Ava
LRMKXENLEELRTLFSSA

SEQ ID NO: 1326 - protein, 18 aa, Artificial Sequence
  Description of Artificial Sequence: Synthetic hybrid peptide
  MOD_RES (5)..(5): Ava
LRMKXPSCDLLLEGREWS

SEQ ID NO: 1327 - protein, 18 aa, Artificial Sequence
  Description of Artificial Sequence: Synthetic hybrid peptide
  MOD_RES (5)..(5): Ava
LRMKXGTCPKYVRVNSLK

SEQ ID NO: 1328 - protein, 18 aa, Artificial Sequence
  Description of Artificial Sequence: Synthetic hybrid peptide
  MOD_RES (5)..(5): Ava
LRMKXTWNVTYTGTSRAC

SEQ ID NO: 1329 - protein, 18 aa, Artificial Sequence
  Description of Artificial Sequence: Synthetic hybrid peptide
  MOD_RES (5)..(5): Ava
LRMKXGAYKILTIYSTVA

SEQ ID NO: 1330 - protein, 18 aa, Artificial Sequence
  Description of Artificial Sequence: Synthetic hybrid peptide
  MOD_RES (5)..(5): Ava
LRMKXTTTSVTTEDLNRT

SEQ ID NO: 1331 - protein, 18 aa, Artificial Sequence
  Description of Artificial Sequence: Synthetic hybrid peptide
  MOD_RES (5)..(5): Ava
LRMKXFPDTTWNVTYTGT

SEQ ID NO: 1332 - protein, 18 aa, Artificial Sequence
  Description of Artificial Sequence: Synthetic hybrid peptide
  MOD_RES (5)..(5): Ava
LRMKXLEGREWSYIVERS

SEQ ID NO: 1333 - protein, 18 aa, Artificial Sequence
  Description of Artificial Sequence: Synthetic hybrid peptide
  MOD_RES (5)..(5): Ava
LRMKXSNGNLIAPWYGHV

SEQ ID NO: 1334 - protein, 18 aa, Artificial Sequence
  Description of Artificial Sequence: Synthetic hybrid peptide
  MOD_RES (5)..(5): Ava
LRMKXKPGQTLRVRSNGN

SEQ ID NO: 1335 - protein, 18 aa, Artificial Sequence
  Description of Artificial Sequence: Synthetic hybrid peptide
  MOD_RES (5)..(5): Ava
LRMKXIIDHEFSEVETRL

SEQ ID NO: 1336 - protein, 18 aa, Artificial Sequence
  Description of Artificial Sequence: Synthetic hybrid peptide
  MOD_RES (5)..(5): Ava
LRMKXGKSILFVWGIHHP

SEQ ID NO: 1337 - protein, 18 aa, Artificial Sequence
  Description of Artificial Sequence: Synthetic hybrid peptide
  MOD_RES (5)..(5): Ava
LRMKXDQIQDVWAYNAEL

SEQ ID NO: 1338 - protein, 18 aa, Artificial Sequence
  Description of Artificial Sequence: Synthetic hybrid peptide
  MOD_RES (5)..(5): Ava
LRMKXSLITILLVVTASN

SEQ ID NO: 1339 - protein, 18 aa, Artificial Sequence
  Description of Artificial Sequence: Synthetic hybrid peptide
  MOD_RES (5)..(5): Ava
LRMKXNAELLVLLENQKT

SEQ ID NO: 1340 - protein, 18 aa, Artificial Sequence
  Description of Artificial Sequence: Synthetic hybrid peptide
  MOD_RES (5)..(5): Ava
LRMKXKILTIYSTVASSL

SEQ ID NO: 1341 - protein, 18 aa, Artificial Sequence
  Description of Artificial Sequence: Synthetic hybrid peptide
  MOD_RES (5)..(5): Ava
LRMKXCDDQCMETIRNGT

SEQ ID NO: 1342 - protein, 18 aa, Artificial Sequence
  Description of Artificial Sequence: Synthetic hybrid peptide
  MOD_RES (5)..(5): Ava
LRMKXTEHNGMLCATSLG

SEQ ID NO: 1343 - protein, 22 aa, Artificial Sequence
  Description of Artificial Sequence: Synthetic hybrid peptide
  MOD_RES (5)..(5): Ava
LRMKXFPDTTWNVTYTGTSRAC

SEQ ID NO: 1344 - protein, 21 aa, Artificial Sequence
  Description of Artificial Sequence: Synthetic hybrid peptide
  MOD_RES (5)..(5): Ava
LRMKXGAYKILTIYSTVASSL

SEQ ID NO: 1345 - protein, 562 aa, Influenza A virus
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGSDYPVAKGSYNNTSGEQMLIIWGVHHPNDETEQRTLYQNVGTYVSVGTSTLNKRSTPEIATRPKVNGQGGRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 1346 - protein, 18 aa, Artificial Sequence
  Description of Artificial Sequence: Synthetic hybrid peptide
  MOD_RES (5)..(5): Ava
LRMKXTHNGKLCKLNGIP

SEQ ID NO: 1347 - protein, 18 aa, Artificial Sequence
  Description of Artificial Sequence: Synthetic hybrid peptide
  MOD_RES (5)..(5): Ava
LRMKXPECDRLLSVPEWS

SEQ ID NO: 1348 - protein, 18 aa, Artificial Sequence
  Description of Artificial Sequence: Synthetic hybrid peptide
  MOD_RES (5)..(5): Ava
LRMKXGSFNDYEELKHLL

SEQ ID NO: 1349 - protein, 18 aa, Artificial Sequence
  Description of Artificial Sequence: Synthetic hybrid peptide
  MOD_RES (5)..(5): Ava
LRMKXHAKDILEKTHNGK

SEQ ID NO: 1350 - protein, 18 aa, Artificial Sequence
  Description of Artificial Sequence: Synthetic hybrid peptide
  MOD_RES (5)..(5): Ava
LRMKXAIIYLILLFTAVR

SEQ ID NO: 1351 - protein, 18 aa, Artificial Sequence
  Description of Artificial Sequence: Synthetic hybrid peptide
  MOD_RES (5)..(5): Ava
LRMKXYLILLFTAVRGDQ

SEQ ID NO: 1352 - protein, 18 aa, Artificial Sequence
  Description of Artificial Sequence: Synthetic hybrid peptide
  MOD_RES (5)..(5): Ava
LRMKXNAELLVLMENERT

SEQ ID NO: 1353 - protein, 18 aa, Artificial Sequence
  Description of Artificial Sequence: Synthetic hybrid peptide
  MOD_RES (5)..(5): Ava
LRMKXEQRTLYQNVGTYV

SEQ ID NO: 1354 - protein, 18 aa, Artificial Sequence
  Description of Artificial Sequence: Synthetic hybrid peptide
  MOD_RES (5)..(5): Ava
LRMKXTGLRNVPQIESRG

SEQ ID NO: 1355 - protein, 18 aa, Artificial Sequence
  Description of Artificial Sequence: Synthetic hybrid peptide
  MOD_RES (5)..(5): Ava
LRMKXKMNTQFEAVGKEF

SEQ ID NO: 1356 - protein, 18 aa, Artificial Sequence
  Description of Artificial Sequence: Synthetic hybrid peptide
  MOD_RES (5)..(5): Ava
LRMKXTLYQNVGTYVSVG

SEQ ID NO: 1357 - protein, 18 aa, Artificial Sequence
  Description of Artificial Sequence: Synthetic hybrid peptide
  MOD_RES (5)..(5): Ava
LRMKXAGSLSLAIMMAGI

SEQ ID NO: 1358 - protein, 18 aa, Artificial Sequence
  Description of Artificial Sequence: Synthetic hybrid peptide
  MOD_RES (5)..(5): Ava
LRMKXQLRDNVKELGNGC

SEQ ID NO: 1359 - protein, 18 aa, Artificial Sequence
  Description of Artificial Sequence: Synthetic hybrid peptide
  MOD_RES (5)..(5): Ava
LRMKXQNVGTYVSVGTST

SEQ ID NO: 1360 - protein, 18 aa, Artificial Sequence
  Description of Artificial Sequence: Synthetic hybrid peptide
  MOD_RES (5)..(5): Ava
LRMKXAIYATVAGSLSLA

SEQ ID NO: 1361 - protein, 18 aa, Artificial Sequence
  Description of Artificial Sequence: Synthetic hybrid peptide
  MOD_RES (5)..(5): Ava
LRMKXSFFRNMVWLTKKG

SEQ ID NO: 1362 - protein, 18 aa, Artificial Sequence
  Description of Artificial Sequence: Synthetic hybrid peptide
  MOD_RES (5)..(5): Ava
LRMKXGVYQILAIYATVA

SEQ ID NO: 1363 - protein, 18 aa, Artificial Sequence
  Description of Artificial Sequence: Synthetic hybrid peptide
  MOD_RES (5)..(5): Ava
LRMKXNKVNSVIEKMNTQ

SEQ ID NO: 1364 - protein, 18 aa, Artificial Sequence
  Description of Artificial Sequence: Synthetic hybrid peptide
  MOD_RES (5)..(5): Ava
LRMKXSTQKAFDGITNKV

SEQ ID NO: 1365 - protein, 18 aa, Artificial Sequence
  Description of Artificial Sequence: Synthetic hybrid peptide
  MOD_RES (5)..(5): Ava
LRMKXNSTEKVDTILERN

SEQ ID NO: 1366 - protein, 18 aa, Artificial Sequence
  Description of Artificial Sequence: Synthetic hybrid peptide
  MOD_RES (5)..(5): Ava
LRMKXAVGKEFSNLERRL

SEQ ID NO: 1367 - protein, 18 aa, Artificial Sequence
  Description of Artificial Sequence: Synthetic hybrid peptide
  MOD_RES (5)..(5): Ava
LRMKXHLLSSVKHFEKVK

SEQ ID NO: 1368 - protein, 18 aa, Artificial Sequence
  Description of Artificial Sequence: Synthetic hybrid peptide
  MOD_RES (5)..(5): Ava
LRMKXCDDECMNSVKNGT

SEQ ID NO: 1369 - protein, 18 aa, Artificial Sequence
  Description of Artificial Sequence: Synthetic hybrid peptide
  MOD_RES (5)..(5): Ava
LRMKXKMEDGFLDVWTYN

SEQ ID NO: 1370 - protein, 18 aa, Artificial Sequence
  Description of Artificial Sequence: Synthetic hybrid peptide
  MOD_RES (5)..(5): Ava
LRMKXWDTINFESTGNLI

SEQ ID NO: 1371 - protein, 18 aa, Artificial Sequence
  Description of Artificial Sequence: Synthetic hybrid peptide
  MOD_RES (5)..(5): Ava
LRMKXAPEYGFKISKRGS

SEQ ID NO: 1372 - protein, 18 aa, Artificial Sequence
  Description of Artificial Sequence: Synthetic hybrid peptide
  MOD_RES (5)..(5): Ava
LRMKXFSWTLLDMWDTIN

SEQ ID NO: 1373 - protein, 18 aa, Artificial Sequence
  Description of Artificial Sequence: Synthetic hybrid peptide
  MOD_RES (5)..(5): Ava
LRMKXQILAIYATVAGSL

SEQ ID NO: 1374 - protein, 18 aa, Artificial Sequence
  Description of Artificial Sequence: Synthetic hybrid peptide
  MOD_RES (5)..(5): Ava
LRMKXIYLILLFTAVRGD

SEQ ID NO: 1375 - protein, 18 aa, Artificial Sequence
  Description of Artificial Sequence: Synthetic hybrid peptide
  MOD_RES (5)..(5): Ava
LRMKXVAKGSYNNTSGEQ

SEQ ID NO: 1376 - protein, 18 aa, Artificial Sequence
  Description of Artificial Sequence: Synthetic hybrid peptide
  MOD_RES (5)..(5): Ava
LRMKXVKLSSMGVYQILA

SEQ ID NO: 1377 - protein, 21 aa, Artificial Sequence
  Description of Artificial Sequence: Synthetic hybrid peptide
  MOD_RES (5)..(5): Ava
LRMKXTLYQNVGTYVSVGTST

SEQ ID NO: 1378 - protein, 13 aa, Artificial Sequence
  Description of Artificial Sequence: Synthetic hybrid peptide
NAELLVLLENERT

SEQ ID NO: 1379 - protein, 13 aa, Artificial Sequence
  Description of Artificial Sequence: Synthetic hybrid peptide
NAELLVALENQHT

SEQ ID NO: 1380 - protein, 13 aa, Artificial Sequence
  Description of Artificial Sequence: Synthetic hybrid peptide
GYFADYEELREQL

SEQ ID NO: 1381 - protein, 13 aa, Artificial Sequence
  Description of Artificial Sequence: Synthetic hybrid peptide
DVVPDYASLRSLV

SEQ ID NO: 1382 - protein, 13 aa, Artificial Sequence
  Description of Artificial Sequence: Synthetic hybrid peptide
DQEGRINYYWTLL

SEQ ID NO: 1383 - protein, 13 aa, Artificial Sequence
  Description of Artificial Sequence: Synthetic hybrid peptide
GLSSRISIYWTIV

SEQ ID NO: 1384 - protein, 13 aa, Artificial Sequence
  Description of Artificial Sequence: Synthetic hybrid peptide
SHNGKLCLLKGIA

SEQ ID NO: 1385 - protein, 13 aa, Artificial Sequence
  Description of Artificial Sequence: Synthetic hybrid peptide
VPNGTLVKTITDD

SEQ ID NO: 1386 - protein, 13 aa, Artificial Sequence
  Description of Artificial Sequence: Synthetic hybrid peptide
EPGDTIIFEANGN

SEQ ID NO: 1387 - protein, 9 aa, Artificial Sequence
  Description of Artificial Sequence: Synthetic hybrid peptide
GDILLINST

SEQ ID NO: 1388 - protein, 13 aa, Artificial Sequence
  Description of Artificial Sequence: Synthetic hybrid peptide
GKNGLYPNLSKSY

SEQ ID NO: 1389 - protein, 9 aa, Artificial Sequence
  Description of Artificial Sequence: Synthetic hybrid peptide
KYKYPALNV

SEQ ID NO: 1390 - protein, 13 aa, Artificial Sequence
  Description of Artificial Sequence: Synthetic hybrid peptide
NSTDTVDTVLEKN

SEQ ID NO: 1391 - protein, 9 aa, Artificial Sequence
  Description of Artificial Sequence: Synthetic hybrid peptide
GTIVKTITN

SEQ ID NO: 1392 - protein, 11 aa, Artificial Sequence
  Description of Artificial Sequence: Synthetic hybrid peptide
APRGYFKIRSG

SEQ ID NO: 1393 - protein, 13 aa, Artificial Sequence
  Description of Artificial Sequence: Synthetic hybrid peptide
GVYQILAIYSTVA

SEQ ID NO: 1394 - protein, 13 aa, Artificial Sequence
  Description of Artificial Sequence: Synthetic hybrid peptide
LGAISFWMCSNGS

SEQ ID NO: 1395 - protein, 13 aa, Artificial Sequence
  Description of Artificial Sequence: Synthetic hybrid peptide
HTENAYVSVVSSH

SEQ ID NO: 1396 - protein, 13 aa, Artificial Sequence
  Description of Artificial Sequence: Synthetic hybrid peptide
VQASGRITVSTRR

SEQ ID NO: 1397 - protein, 13 aa, Artificial Sequence
  Description of Artificial Sequence: Synthetic hybrid peptide
LSKSYVNNKEKEV

SEQ ID NO: 1398 - protein, 9 aa, Artificial Sequence
  Description of Artificial Sequence: Synthetic hybrid peptide
NVTMPNNEK

SEQ ID NO: 1399 - protein, 13 aa, Artificial Sequence
  Description of Artificial Sequence: Synthetic hybrid peptide
SFYRNLLWLTGKN

SEQ ID NO: 1400 - protein, 13 aa, Artificial Sequence
  Description of Artificial Sequence: Synthetic hybrid peptide
GFFSRLNWLTHSG

SEQ ID NO: 1401 - protein, 13 aa, Artificial Sequence
  Description of Artificial Sequence: Synthetic hybrid peptide
EQLSSVSSFERFE

SEQ ID NO: 1402 - protein, 13 aa, Artificial Sequence
  Description of Artificial Sequence: Synthetic hybrid peptide
SLVASSGTLEFIT

SEQ ID NO: 1403 - protein, 13 aa, Artificial Sequence
  Description of Artificial Sequence: Synthetic hybrid peptide
KMNTQFTAVGKEF

SEQ ID NO: 1404 - protein, 13 aa, Artificial Sequence
  Description of Artificial Sequence: Synthetic hybrid peptide
VKLESMGVYQILA

SEQ ID NO: 1405 - protein, 13 aa, Artificial Sequence
  Description of Artificial Sequence: Synthetic hybrid peptide
NSSLPFQNVHPVT

SEQ ID NO: 1406 - protein, 13 aa, Artificial Sequence
  Description of Artificial Sequence: Synthetic hybrid peptide
PNDKPFQNVNRIT

SEQ ID NO: 1407 - protein, 13 aa, Artificial Sequence
  Description of Artificial Sequence: Synthetic hybrid peptide
NKVNSVIEKMNTQ

SEQ ID NO: 1408 - protein, 13 aa, Artificial Sequence
  Description of Artificial Sequence: Synthetic hybrid peptide
KVDDGFLDIWTYN

SEQ ID NO: 1409 - protein, 13 aa, Artificial Sequence
  Description of Artificial Sequence: Synthetic hybrid peptide
MGVYQILAIYSTV

SEQ ID NO: 1410 - protein, 13 aa, Artificial Sequence
  Description of Artificial Sequence: Synthetic hybrid peptide
AVGKEFNKLERRM

SEQ ID NO: 1411 - protein, 13 aa, Artificial Sequence
  Description of Artificial Sequence: Synthetic hybrid peptide
CYPGYFADYEELR

SEQ ID NO: 1412 - protein, 13 aa, Artificial Sequence
  Description of Artificial Sequence: Synthetic hybrid peptide
CYPYDVPDYASLR

SEQ ID NO: 1413 - protein, 13 aa, Artificial Sequence
  Description of Artificial Sequence: Synthetic hybrid peptide
SNVKNLYEKVKSQ

SEQ ID NO: 1414 - protein, 13 aa, Artificial Sequence
  Description of Artificial Sequence: Synthetic hybrid peptide
GWTGMVDGWYGYH

SEQ ID NO: 1415 - protein, 13 aa, Artificial Sequence
  Description of Artificial Sequence: Synthetic hybrid peptide
GWEGMIDGWYGFR

SEQ ID NO: 1416 - protein, 110 aa, Homo sapeins
MALWMRLLPLLALLALWGPDPAAAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 1417 - protein, 30 aa, Homo sapeins
FVNQHLCGSHLVEALYLVCGERGFFYTPKT

SEQ ID NO: 1418 - protein, 19 aa, Artificial Sequence
  Description of Artificial Sequence: Synthetic hybrid peptide
  MOD_RES (5)..(5): Ava
LRMKXNQHLCGSHLVEALY

SEQ ID NO: 1419 - protein, 18 aa, Artificial Sequence
  Description of Artificial Sequence: Synthetic hybrid peptide
  MOD_RES (5)..(5): Ava
LRMKXQHLCGSHLVEALY

SEQ ID NO: 1420 - protein, 17 aa, Artificial Sequence
  Description of Artificial Sequence: Synthetic hybrid peptide
  MOD_RES (5)..(5): Ava
LRMKXHLCGSHLVEALY

SEQ ID NO: 1421 - protein, 16 aa, Artificial Sequence
  Description of Artificial Sequence: Synthetic hybrid peptide
  MOD_RES (5)..(5): Ava
LRMKXLCGSHLVEALY

SEQ ID NO: 1422 - protein, 14 aa, Artificial Sequence
  Description of Artificial Sequence: Synthetic hybrid peptide
NQHLCGSHLVEALY

SEQ ID NO: 1423 - protein, 21 aa, Artificial Sequence
  Description of Artificial Sequence: Synthetic hybrid peptide
  MOD_RES (5)..(5): Ava
LRMKXVEALYLVCGERGFFYT

SEQ ID NO: 1424 - protein, 20 aa, Artificial Sequence
  Description of Artificial Sequence: Synthetic hybrid peptide
  MOD_RES (5)..(5): Ava
LRMKXEALYLVCGERGFFYT

SEQ ID NO: 1425 - protein, 19 aa, Artificial Sequence
  Description of Artificial Sequence: Synthetic hybrid peptide
  MOD_RES (5)..(5): Ava
LRMKXALYLVCGERGFFYT

SEQ ID NO: 1426 - protein, 18 aa, Artificial Sequence
  Description of Artificial Sequence: Synthetic hybrid peptide
  MOD_RES (5)..(5): Ava
LRMKXLYLVCGERGFFYT

SEQ ID NO: 1427 - protein, 17 aa, Artificial Sequence
  Description of Artificial Sequence: Synthetic hybrid peptide
  MOD_RES (5)..(5): Ava
LRMKXYLVCGERGFFYT

SEQ ID NO: 1428 - protein, 16 aa, Artificial Sequence
  Description of Artificial Sequence: Synthetic hybrid peptide
VEALYLVCGERGFFYT

SEQ ID NO: 1429 - protein, 21 aa, Homo sapeins
GIVEQCCTSICSLYQLENYCN

SEQ ID NO: 1430 - protein, 20 aa, Artificial Sequence
  Description of Artificial Sequence: Synthetic hybrid peptide
  MOD_RES (5)..(5): Ava
LRMKXGIVEQCCTSICSLYQ

SEQ ID NO: 1431 - protein, 19 aa, Artificial Sequence
  Description of Artificial Sequence: Synthetic hybrid peptide
  MOD_RES (5)..(5): Ava
LRMKXIVEQCCTSICSLYQ

SEQ ID NO: 1432 - protein, 18 aa, Artificial Sequence
  Description of Artificial Sequence: Synthetic hybrid peptide
  MOD_RES (5)..(5): Ava
LRMKXVEQCCTSICSLYQ

SEQ ID NO: 1433 - protein, 17 aa, Artificial Sequence
  Description of Artificial Sequence: Synthetic hybrid peptide
  MOD_RES (5)..(5): Ava
LRMKXEQCCTSICSLYQ

SEQ ID NO: 1434 - protein, 16 aa, Artificial Sequence
  Description of Artificial Sequence: Synthetic hybrid peptide
  MOD_RES (5)..(5): Ava
LRMKXQCCTSICSLYQ

SEQ ID NO: 1435 - protein, 15 aa, Artificial Sequence
  Description of Artificial Sequence: Synthetic hybrid peptide
  MOD_RES (5)..(5): Ava
LRMKXCCTSICSLYQ

SEQ ID NO: 1436 - protein, 14 aa, Artificial Sequence
  Description of Artificial Sequence: Synthetic hybrid peptide
  MOD_RES (5)..(5): Ava
LRMKXCTSICSLYQ

SEQ ID NO: 1437 - protein, 15 aa, Artificial Sequence
  Description of Artificial Sequence: Synthetic hybrid peptide
GIVEQCCTSICSLYQ

SEQ ID NO: 1438 - protein, 35 aa, Homo sapeins
RREAEDLQVGQVELGGGPGAGSLQPLALEGSLQKR

SEQ ID NO: 1439 - protein, 19 aa, Artificial Sequence
  Description of Artificial Sequence: Synthetic hybrid peptide
  MOD_RES (5)..(5): Ava
LRMKXRREAEDLQVGGVEL

SEQ ID NO: 1440 - protein, 18 aa, Artificial Sequence
  Description of Artificial Sequence: Synthetic hybrid peptide
  MOD_RES (5)..(5): Ava
LRMKXREAEDLQVGGVEL

SEQ ID NO: 1441 - protein, 17 aa, Artificial Sequence
  Description of Artificial Sequence: Synthetic hybrid peptide
  MOD_RES (5)..(5): Ava
LRMKXEAEDLQVGGVEL

SEQ ID NO: 1442 - protein, 16 aa, Artificial Sequence
  Description of Artificial Sequence: Synthetic hybrid peptide
  MOD_RES (5)..(5): Ava
LRMKXAEDLQVGGVEL

SEQ ID NO: 1443 - protein, 15 aa, Artificial Sequence
  Description of Artificial Sequence: Synthetic hybrid peptide
  MOD_RES (5)..(5): Ava
LRMKXEDLQVGGVEL

SEQ ID NO: 1444 - protein, 14 aa, Artificial Sequence
  Description of Artificial Sequence: Synthetic hybrid peptide
RREAEDLQVGGVEL

SEQ ID NO: 1445 - protein, 19 aa, Artificial Sequence
  Description of Artificial Sequence: Synthetic hybrid peptide
  MOD_RES (5)..(5): Ava
LRMKXLQVGGVELGGGPGA

SEQ ID NO: 1446 - protein, 18 aa, Artificial Sequence
  Description of Artificial Sequence: Synthetic hybrid peptide
  MOD_RES (5)..(5): Ava
LRMKXQVGGVELGGGPGA

SEQ ID NO: 1447 - protein, 17 aa, Artificial Sequence
  Description of Artificial Sequence: Synthetic hybrid peptide
  MOD_RES (5)..(5): Ava
LRMKXVGGVELGGGPGA

SEQ ID NO: 1448 - protein, 16 aa, Artificial Sequence
  Description of Artificial Sequence: Synthetic hybrid peptide
  MOD_RES (5)..(5): Ava
LRMKXGGVELGGGPGA

SEQ ID NO: 1449 - protein, 15 aa, Artificial Sequence
  Description of Artificial Sequence: Synthetic hybrid peptide
  MOD_RES (5)..(5): Ava
LRMKXGVELGGGPGA

SEQ ID NO: 1450 - protein, 14 aa, Artificial Sequence
  Description of Artificial Sequence: Synthetic hybrid peptide
LQVGGVELGGGPGA

SEQ ID NO: 1451 - protein, 5 aa, Artificial Sequence
  Description of Artificial Sequence: Modified mammalian li-key peptide
  MOD_RES (1)..(1): Ava
XKMRL

SEQ ID NO: 1452 - protein, 10 aa, Homo sapiens
YMDGTMSQVN

SEQ ID NO: 1453 - protein, 14 aa, Homo sapiens
SHLVEALYLVCGER

SEQ ID NO: 1454 - protein, 17 aa, Homo sapiens
FVNQHLCGSHLVEALYL

SEQ ID NO: 1455 - protein, 22 aa, Homo sapiens
LGGGPGAGSLQPLALEGSLQKR

The invention claimed is:

1. A method for increasing the potency of a vaccine directed toward Influenza A strain H5N1 in a subject, the method comprising:
   a) providing a vaccine, the vaccine comprising an epitope-containing protein or portion thereof which is encoded by the genome of the pathogen, or a DNA encoding the same;
   b) providing an Ii-key hybrid construct comprising:
      i. the LRMK residues of Ii-key protein; and
      ii. an MHC class II epitope contained within the protein or portion thereof of step a), wherein said class II epitope is selected from a group consisting of the residues GLSLWMCSN [amino acid residues 8-16 of SEQ ID NO: 1167], residues FRNVIWLIK [amino acid residues 8-16 of SEQ ID NO: 1170] and the residues SGRMEFFWT [amino acid residues 8-16 of SEQ ID NO: 1159];
   c) priming the immune system of the subject by administering the Ii-key construct of step b) under conditions appropriate for the stimulation of an immune response in the subject; and
   d) administering the vaccine of step a) under conditions appropriate to boost the immune response of step c) thereby increasing the potency of the vaccine relative to a non-primed administration.

2. The method of claim 1 wherein the protein of step a) is produced by recombinant DNA technology.

3. The method of claim 1 wherein the subject is a mammal.

4. The method of claim 1 wherein the subject is a human.

5. The method of claim 1 wherein the MHC class II epitope consists of the residues GLSLWMCSN [amino acid residues 8-16 of SEQ ID NO: 1167].

6. The method of claim 1 wherein the MHC class II epitope consists of the residues FRNVIWLIK [amino acid residues 8-16 of SEQ ID NO: 1170].

7. The method of claim 1 wherein the MHC class II epitope consists of the residues SGRMEFFWT [amino acid residues 8-16 of SEQ ID NO: 1159].

8. The method of claim 1, wherein both said vaccine and said Ii-key hybrid construct comprise peptides.

* * * * *